US009993507B2

(12) United States Patent
Embree et al.

(10) Patent No.: US 9,993,507 B2
(45) Date of Patent: *Jun. 12, 2018

(54) METHODS OF IMPROVING MILK PRODUCTION AND COMPOSITIONAL CHARACTERISTICS

(71) Applicant: Ascus Biosciences, Inc., San Diego, CA (US)

(72) Inventors: Mallory Embree, Vista, CA (US); Luke Picking, San Diegp, CA (US); Grant Gogul, Cardiff, CA (US); Janna Tarasova, San Diego, CA (US)

(73) Assignee: Ascus Biosciences, Inc., San Diego, CA (US)

( * ) Notice: Subject to any disclaimer, the term of this patent is extended or adjusted under 35 U.S.C. 154(b) by 0 days. days.

This patent is subject to a terminal disclaimer.

(21) Appl. No.: 15/400,484

(22) Filed: Jan. 6, 2017

(65) Prior Publication Data

US 2017/0196922 A1 Jul. 13, 2017

Related U.S. Application Data

(60) Provisional application No. 62/276,142, filed on Jan. 7, 2016, provisional application No. 62/276,531, filed on Jan. 8, 2016, provisional application No. 62/334,816, filed on May 11, 2016, provisional application No. 62/415,908, filed on Nov. 1, 2016.

(51) Int. Cl.

| A23K 50/10 | (2016.01) |
|---|---|
| A61K 36/064 | (2006.01) |
| A61K 35/74 | (2015.01) |
| A61K 36/06 | (2006.01) |
| A23K 40/35 | (2016.01) |
| A61K 9/00 | (2006.01) |
| A61K 35/742 | (2015.01) |
| A23K 10/18 | (2016.01) |

(52) U.S. Cl.
CPC ............ *A61K 36/064* (2013.01); *A23K 10/18* (2016.05); *A23K 40/35* (2016.05); *A23K 50/10* (2016.05); *A61K 9/0019* (2013.01); *A61K 9/0053* (2013.01); *A61K 35/74* (2013.01); *A61K 35/742* (2013.01); *A61K 36/06* (2013.01)

(58) Field of Classification Search
None
See application file for complete search history.

(56) References Cited

U.S. PATENT DOCUMENTS

| 3,484,243 A | 12/1969 | Anderson et al. |
|---|---|---|
| 4,647,536 A | 3/1987 | Mosbach et al. |
| 5,104,662 A | 4/1992 | Kalsta et al. |
| 5,605,793 A | 2/1997 | Stemmer |
| 5,733,568 A | 3/1998 | Ford |
| 5,837,458 A | 11/1998 | Minshull et al. |
| 6,210,891 B1 | 4/2001 | Nyren et al. |
| 6,214,337 B1 | 4/2001 | Hayen et al. |
| 6,258,568 B1 | 7/2001 | Nyren |
| 6,274,320 B1 | 8/2001 | Rothberg et al. |
| 6,841,168 B1 | 11/2005 | Worrell |
| 7,427,408 B2 | 9/2008 | Merritt et al. |
| 7,998,502 B2 | 8/2011 | Harel |
| 8,071,295 B2 | 12/2011 | Ashby |
| 8,097,245 B2 | 1/2012 | Harel et al. |
| 8,114,396 B2 | 2/2012 | Horn et al. |
| 8,345,010 B2 | 1/2013 | Fitzgibbon et al. |
| 8,460,726 B2 | 6/2013 | Harel et al. |
| 8,906,668 B2 | 12/2014 | Henn et al. |
| 9,011,834 B1 | 4/2015 | Mckenzie et al. |
| 9,028,841 B2 | 5/2015 | Henn et al. |
| 9,113,636 B2 | 8/2015 | Von Maltzahn et al. |
| 9,179,694 B2 | 11/2015 | Porter et al. |
| 9,180,147 B2 | 11/2015 | Mckenzie et al. |
| 9,206,680 B2 | 12/2015 | Ashby et al. |
| 9,288,995 B2 | 3/2016 | Von Maltzahn et al. |
| 9,295,263 B2 | 3/2016 | Von Maltzahn et al. |
| 9,404,162 B2 | 8/2016 | Boileau et al. |

(Continued)

FOREIGN PATENT DOCUMENTS

| EP | 0553444 B1 | 3/1998 |
|---|---|---|
| EP | 0664671 B1 | 9/2002 |

(Continued)

OTHER PUBLICATIONS

Tashiro, Yukihiro, et al. "High butanol production by Clostridium saccharoperbutylacetonicum N1-4 in fed-batch culture with pH-stat continuous butyric acid and glucose feeding method." Journal of bioscience and bioengineering 98.4 (2004): 263-268.*
Coulona, Jean-Baptiste, et al. "Effect of mastitis and related-germ on milk yield and composition during naturally-occurring udder infections in dairy cows." Animal Research 51.05 (2002): 383-393.*
Gröhn, Y. T., et al. "Effect of pathogen-specific clinical mastitis on milk yield in dairy cows." Journal of dairy science 87.10 (2004): 3358-3374.*
Sirisan, V., et al. "Isolation, identification and growth determination of lactic acid-utilizing yeasts from the ruminal fluid of dairy cattle." Letters in applied microbiology 57.2 (2013): 102-107.*
Abu-Tarboush, et al. "Evaluation of diet containing lactobacilli on performance, fecal coliform, and lactobacilli of young dairy calves." Animal Feed Science and Technology (1996); 57;1-2: 39-49.
Alkman, P. C., et al. "Rumen pH and fermentation characteristics in dairy cows supplemented with Megasphaera elsdenii NCIMB 41125 in early lactation." Journal of Dairy Science (2011); 94.6: 2840-2849.

(Continued)

*Primary Examiner* — Robert J Yamasaki
(74) *Attorney, Agent, or Firm* — Cooley LLP

(57) ABSTRACT

The disclosure relates to isolated microorganisms—including novel strains of the microorganisms—microbial consortia, and compositions comprising the same. Furthermore, the disclosure teaches methods of utilizing the described microorganisms, microbial consortia, and compositions comprising the same, in methods for modulating the production and yield of milk and milk components in ruminants. In particular aspects, the disclosure provides methods of increasing desirable components of milk in ruminants. Furthermore, the disclosure provides for methods of modulating the rumen microbiome.

27 Claims, 21 Drawing Sheets

(56) References Cited

U.S. PATENT DOCUMENTS

| | | | |
|---|---|---|---|
| 9,446,080 | B2 | 9/2016 | Mckenzie et al. |
| 9,469,835 | B2 | 10/2016 | Bronshtein |
| 9,532,572 | B2 | 1/2017 | Mckenzie et al. |
| 9,532,573 | B2 | 1/2017 | Von Maltzahn et al. |
| 9,533,014 | B2 | 1/2017 | Henn et al. |
| 9,540,676 | B1 | 1/2017 | Zengler et al. |
| 9,562,271 | B2 | 2/2017 | Neely |
| 9,622,485 | B2 | 4/2017 | Von Maltzahn et al. |
| 9,642,881 | B2 | 5/2017 | Honda et al. |
| 9,649,345 | B2 | 5/2017 | Honda et al. |
| 9,700,586 | B2 | 7/2017 | Bicalho et al. |
| 9,901,605 | B2 | 2/2018 | Garner et al. |
| 9,903,002 | B2 | 2/2018 | Zeng et al. |
| 9,909,180 | B2 | 3/2018 | Quake et al. |
| 9,938,558 | B2 | 4/2018 | Embree |
| 2005/0239706 | A1 | 10/2005 | Backhed et al. |
| 2011/0280840 | A1 | 11/2011 | Blaser et al. |
| 2012/0149584 | A1 | 6/2012 | Olle et al. |
| 2014/0171339 | A1 | 6/2014 | Keku et al. |
| 2015/0213193 | A1 | 7/2015 | Apte et al. |
| 2015/0216817 | A1 | 8/2015 | Luhman |
| 2015/0218614 | A1 | 8/2015 | Henderson et al. |
| 2015/0267163 | A1 | 9/2015 | Liao et al. |
| 2016/0040119 | A1 | 2/2016 | Hashman |
| 2016/0376627 | A1 | 12/2016 | Zengler et al. |
| 2017/0107557 | A1 | 4/2017 | Embree et al. |
| 2017/0196921 | A1 | 7/2017 | Embree et al. |
| 2017/0342457 | A1 | 11/2017 | Embree et al. |
| 2018/0030516 | A1 | 2/2018 | Nawana et al. |
| 2018/0044712 | A1 | 2/2018 | Embree |
| 2018/0051310 | A1 | 2/2018 | Hallock et al. |
| 2018/0051327 | A1 | 2/2018 | Blainey et al. |
| 2018/0070825 | A1 | 3/2018 | Apte et al. |
| 2018/0080065 | A1 | 3/2018 | Jain |

FOREIGN PATENT DOCUMENTS

| | | | | |
|---|---|---|---|---|
| KR | 1020130127784 B1 | * | 11/2013 | ............... C12N 1/16 |
| WO | WO 1993/25232 A1 | | 12/1993 | |
| WO | WO 2006117019 A1 | * | 11/2006 | ........... A61K 35/742 |
| WO | WO 2008/076975 A1 | | 6/2008 | |
| WO | WO 2010/111347 A2 | | 9/2010 | |
| WO | WO 2010/111565 A2 | | 9/2010 | |
| WO | WO 2010/138522 A2 | | 12/2010 | |
| WO | WO 2011/075138 A1 | | 6/2011 | |
| WO | WO 2011/094469 A2 | | 8/2011 | |
| WO | WO 2012/077038 A1 | | 6/2012 | |
| WO | WO 2012/122522 A2 | | 9/2012 | |
| WO | wo 2014/141274 A1 | | 9/2014 | |
| WO | WO 2015/023461 A2 | | 2/2015 | |
| WO | WO 2015/068054 A1 | | 5/2015 | |
| WO | WO 2016/007544 A1 | | 1/2016 | |
| WO | WO 2016/127956 A1 | | 8/2016 | |
| WO | WO 2016/153247 A1 | | 9/2016 | |
| WO | WO 2016/210251 A1 | | 12/2016 | |
| WO | WO 2017/120495 A1 | | 7/2017 | |
| WO | WO 2017/131821 A1 | | 8/2017 | |

OTHER PUBLICATIONS

Almeida, Elionor RP, et al. "Transgenic expression of two marker genes under the control of an *Arabidopsis* rbcS promoter: Sequences encoding the Rubisco transit peptide increase expression levels." Molecular and General Genetics MGG (1989); 218.1: 78-86.

Bauman et al., "Nutrigenomics, Rumen-Derived Bioactive Fatty Acids, and the Regulation of Milk Fat Synthesis," Annual Review of Nutrition (2011); 31: 299-319.

Bennett et al., "Toward the 1,000 dollars human genome," Pharmacogenomics (2005); 6(4):373-382.

Bentley et al., "Accurate whole genome sequencing using reversible terminator chemistry," Nature (2008); 456: 53-59.

Blondel et al., "Fast unfolding of communities in large networks," Journal of Statistical Mechanics: Theory and Experiment, (2008); 2008.10.

Boyd, J., "Effects of the addition of direct-fed microbials and glycerol to the diet of lactating dairy cows on milk yield and apparent efficiency of yield." Journal of Dairy Science (2011); 94.9: 4616-4622.

Cacite, F., and Weimer, P. J. "1611 Ruminal dosing with Megasphaera elsdenii and strain persistence are associated with milk fat depression in Holstein cows." J. Anim. Sci vol. (2016); 94, E-Suppl. 5/J. Dairy Sci. vol. 99, E-Suppl. 1, p. 784, 1 page.

Chiquette, J., et al. "Use of Prevotella bryantii 25A and a commercial probiotic during subacute acidosis challenge in midlactation dairy cows." Journal of Dairy Science (2012); 95.10: 5985-5995.

Chiquette, J., et al. "Prevotella bryantii 25A used as a probiotic in early-lactation dairy cows: effect on ruminal fermentation characteristics, milk production, and milk composition." Journal of Dairy Science (2008); 91.9: 3536-3543.

Colby, S. R. "Calculating synergistic and antagonistic responses of herbicide combinations." Weeds (1967); 20-22.

Crameri, Andreas, et al. "Molecular evolution of an arsenate detoxification pathway by DNA shuffling." Nature Biotechnology (1997); 15.5: 436-438.

Crameri, Andreas, et al. "DNA shuffling of a family of genes from diverse species accelerates directed evolution." Nature (1998); 391.6664: 288-291.

Caporaso et al., "Ultra-high-throughput microbial community analysis on the Illumina HiSeq and MiSeq platforms," The ISME Journal (2012); 6: 1621-1624.

Embree, Mallory, et al. "Networks of energetic and metabolic interactions define dynamics in microbial communities." Proceedings of the National Academy of Sciences (2015); 112.50: 15450-15455.

de Menezes, Alexandre B., et al. "Microbiome analysis of dairy cows fed pasture or total mixed ration diets." FEMS Microbiology Ecology (2011); 78.2: 256-265.

Dosogne, Hilde, et al. "Differential leukocyte count method for bovine low somatic cell count milk." Journal of Dairy Science (2003); 86.3: 828-834.

Fadrosh et al., "An improved dual-indexing approach for multiplexed 16S rRNA gene sequencing on the Illumina MiSeq platform," Microbiome (2014); 2:6.

Falkowski et al., "Primary production of the biosphere: integrating terrestrial and oceanic components," Science (1998); 281(5374): 237-240.

Higginbotham, G. E., and Bath, D.L. "Evaluation of Lactobacillus Fermentation Cultures in Calf Feeding Systemsl." Journal of Dairy Science (1993); 76.2: 615-620.

Huhtanen, Pekka, et al. "Effect of increasing ruminal butyrate on milk yield and blood constituents in dairy cows fed a grass silage-based diet." Journal of Dairy Science (1993); 76.4: 1114-1124.

Ingolia et al., "Genome-wide analysis in vivo of translation with nucleotide resolution using ribosome profiling," Science (2009); 324(5924): 218-223.

Ingolia, N.T., "Ribosome profiling: new views of translation, from single codons to genome scale," Nat Rev Genet. (2014); 15(3): 205-213.

International Patent Application No. PCT/US2016/039221, International Search Report and Written Opinion dated Sep. 23, 2016, 14 pages.

Jones, Jonathan D.G., et al. "High level expression of introduced chimaeric genes in regenerated transformed plants." The EMBO Journal (1985); 4.10: 2411.

Kim, Y. J., et al. "The enrichment of a ruminal bacterium (*Megasphaera elsdenii* YJ-4) that produces the trans-10, cis-12 isomer of conjugated linoleic acid." Journal of Applied Microbiology (2002); 92.5: 976-982.

Kõljalg, Urmas, et al. "UNITE: a database providing web-based methods for the molecular identification of ectomycorrhizal fungi." New Phytologist (2005); 166.3: 1063-1068.

Jewell et al., "Ruminal Bacterial Community Composition in Dairy Cows is Dynamic over the Course of Two Lactations and Correlates with Feed Efficiency," Applied and Environmental Microbiology (2015); 81(14): 4697-4710.

(56) References Cited

OTHER PUBLICATIONS

Lan, Yemin, et al. "Using the RDP classifier to predict taxonomic novelty and reduce the search space for finding novel organisms." PLoS One (2012); 7.3: e32491.
Lange et al., "Cost-efficient high-throughput HLA typing by MiSeq amplicon sequencing," BMC Genomics (2014); 15.1:63, 11 pages.
Lee, Dong-Hun, et la. . "Nonradioactive method to study genetic profiles of natural bacterial communities by PCR-single-strand-conformation polymorphism." Applied and Environmental Microbiology (1996); 62.9: 3112-3120.
Lee, K., et al. "Antiobesity effect of trans-10, cis-12-conjugated linoleic acid-producing Lactobacillus plantarum PL62 on diet-induced obese mice." Journal of Applied Microbiology (2007); 103.4: 1140-1146.
Lowe, Susan E., et al. "Growth of anaerobic rumen fungi on defined and semi-defined media lacking rumen fluid." Microbiology (1985); 131.9: 2225-2229.
Lee et al., "Nonradioactive Method to Study Genetic Profiles of Natural Bacterial Communities by PCR-Single-Strand-Conformation Polymorphism," Applied and Environmental Microbiology (1996); 62(9): 3112-3120.
Li et al., "Quantifying absolute protein synthesis rates reveals principles underlying allocation of cellular resources," Cell (2013);157(3): 624-635.
Mardis, Elaine R., "Next Generation DNA Sequencing Methods," Annu. Rev. Genomics Hum. Genet. (2008); 9: 387-402.
McGilliard, M. L., and Stallings, C. C. "Increase in milk yield of commercial dairy herds fed a microbial and enzyme supplement." Journal of Dairy Science (1998); 81.5: 1353-1357.
Margulies et al., "Genome sequencing in microfabricated high-density picolitre reactors," Nature (2005); 437: 376-380.
Mohammed, R., et al. "Changes in ruminal bacterial community composition following feeding of alfalfa ensiled with a lactic acid bacterial inoculant." Journal of Dairy Science (2012); 95.1: 328-339.
Massol-Deya, A.A. et al., Bacterial community fingerprinting of amplified 16S and 16-23S ribosomal DNA gene sequences and restriction endonuclease analysis (ARDRA). In: Akkermans, A.D.L, et al., (Eds.), Molecular Microbial Ecology Manual, vol. 3.3.2. Kluwer Academic Publishers, Dordrecht, pp. 1-8.
Moore, Jeffrey C., et al. "Strategies for the in vitro evolution of protein function: enzyme evolution by random recombination of improved sequences." Journal of Molecular Biology (1997); 272.3: 336-347.
Mitra et al., "Analysis of the intestinal microbiota using SOLiD 16S rRNA gene sequencing and SOLiD shotgun sequencing," BMC Genomics (2013); 14(Suppl 5):S16.
Palmonari et al., "pH dynamics and bacterial community composition in the rumen of lactating dairy cows," J. Dairy Sci. (2010); 93(1): 279-287.
Peckham et al., "SOLiD™ Sequencing and 2-Base Encoding," San Diego, CA: American Society of Human Genetics, Poster No. 2624 (2007), 1 page.
Petri, Renee M., et al. "Characterization of the core rumen microbiome in cattle during transition from forage to concentrate as well as during and after an acidotic challenge." PLoS One (2013); 8.12: e83424.
Pool-Zobel et al., "Overview of Experimental Data on Reduction of Colorectal Cancer Risk by Inulin-Type Fructans," J. Nutr. (2007); 137: 2580S-2584S.
Qiu, Yu, et al. "Characterizing the interplay between multiple levels of organization within bacterial sigma factor regulatory networks." Nature Communications (2013); 4: 1755 (pp. 1-10).
Raeth-Knight, M. L., et al. "Effect of direct-fed microbials on performance, diet digestibility, and rumen characteristics of Holstein dairy cows." Journal of Dairy Science (2007); 90.4: 1802-1809.
Ramirez-Farias et al., "Effect of inulin on the human gut microbiota: stimulation of Bifidobacterium adolescentis and Faecalibacterium prausnitzii," Br J Nutr (2009); 101(4): 541-550.

Ranjard et al., "Sampling strategy in molecular microbial ecology: influence of soil sample size on DNA fingerprinting analysis of fungal and bacterial communities," Environmental Microbiology 5(11); 1111-1120 (2003).
Rook, J. A. F., and Balch, C.C. "The effects of intraruminal infusions of acetic, propionic and butyric acids on the yield and composition of the milk of the cow." British Journal of Nutrition (1961); 15.03: 361-369.
Sandri et al., "Microbial biodiversity of the liquid fraction of rumen content from lactating cows," Animal (2014); 8(4):572-579.
Sanger et al., "DNA sequencing with chain-terminating inhibitors," Proc Natl. Acad. Sci. USA (1977); 74(12): 5463-5467.
San Miguel et al., "Effects of organochlorines on microbial diversity and community structure in Phragmites australis rhizosphere," Appl Microbiol Biotechnol (2014); 98(9): 4257-4266.
Scheinert et al., "Molecular differentiation of bacteria by PCR amplification of the 16-23S rRNA spacer," J Microbiol Meth (1996); 26: 103-117.
Schloss, Patrick D., et al. "Assessing and improving methods used in operational taxonomic unit-based approaches for 16S rRNA gene sequence analysis." Applied and Environmental Microbiology (2011); 77.10: 3219-3226.
Schogor, Ana L.B., et al. "Ruminal prevotella spp. may play an important role in the conversion of plant lignans into human health beneficial antioxidants." PloS One (2014); 9.4: e87949. 10 pages.
Schwieger et al., "A New Approach to Utilize PCR-Single-Strand-Conformation Polymorphism for the 16S rRNA Gene-Based Microbial Community Analysis," Applied and Environmental Microbiology (1998); 64(12): 4870-4876.
Segata et al., "Computational meta'omics for microbial community studies," Molecular Systems Biology 9(1): 666 (2013).
Segata, Nicola, et al. "Metagenomic biomarker discovery and explanation." Genome Biology (2011); 12.6: R60.
Shanks, Orin C., et al. "Community structures of fecal bacteria in cattle from different animal feeding operations." Applied and Environmental Microbiology (2011); 77.9; 2992-3001.
Stemmer, Willem PC. "Rapid evolution of a protein in vitro by DNA shuffling." Nature (1994); 370.6488: 389-391.
Stemmer, Willem P. "DNA shuffling by random fragmentation and reassembly: in vitro recombination for molecular evolution." Proceedings of the National Academy of Sciences (1994); 91.22: 10747-10751.
Tao, N., et al. "Variations in bovine milk oligosaccharides during early and middle lactation stages analyzed by high-performance liquid chromatography-chip/mass spectrometry." Journal of Dairy Science (2009); 92.7: 2991-3001.
Human Microbiome Project Consortium. "Structure, function and diversity of the healthy human microbiome." Nature (2012); 486(7402): 207-214.
Van Houtert, M. F. J. "The production and metabolism of volatile fatty acids by ruminants fed roughages: A review." Animal Feed Science and Technology (1993); 43(3): 189-225.
Vandamme, Peter, et al. "Polyphasic taxonomy, a consensus approach to bacterial systematics." Microbiological Reviews (1996); 60.2: 407-438.
Wagg et al. "Soil biodiversity and soil community composition determine ecosystem multifunctionality." Proceedings of the National Academy of Sciences (2014); 111(14): 5266-5270.
Yarza, Pablo, et al. "Uniting the classification of cultured and uncultured bacteria and archaea using 16S rRNA gene sequences." Nature Reviews Microbiology (2014); 12.9: 635-645.
Zebeli, Qendrim, et al. "Intraruminal administration of Megasphaera elsdenii modulated rumen fermentation profile in mid-lactation dairy cows." Journal of Dairy Research (2012); 79.01; 16-25.
Zhou et al. "High-Throughput Metagenomic Technologies for Complex Microbial Community Analysis: Open and Closed formats." MBio (2015); 6(1): e02288-14, 17 pages.
Zhang, Ji-Hu, et al. "Directed evolution of a fucosidase from a galactosidase by DNA shuffling and screening." Proceedings of the National Academy of Sciences (1997); 94.9: 4504-4509.
Li, M, et al. Uncultured Bacterium Clone SJTU_A3_11_21 16S Ribosomal RNA Gene, Partial Sequence. GenBank Accession No.

(56) References Cited

OTHER PUBLICATIONS

EF403757.1. Submitted Jan. 26, 2007; downloaded from internet <https://www.ncbi.nlm.nih.gov/nucleotide/126114074?report=genbank&log$=nuclalign&blast_rank=1&RID=G57ADV19015> on Apr. 27, 2017, p. 1.

Jewell, K. A. et al., Ruminal Bacterial Community Composition in Dairy Cows is Dynamic over the Course of Two Lactations and Correlates with Feed Efficiency. Applied and Environmental Microbiology. May 1, 2015, vol. 81, No. 14, pp. 4697-4710.

International Search Report and Written Opinion, dated Jun. 7, 2017, for PCT International Application No. PCT/US2017/012573.

Chi et al., "Increase in antioxidant enzyme activity, stress tolerance and biocontrol efficacy of Pichia kudriavzevii with he transition from a yeast-like to biofilm morphology." Biological Control, 90: 113-119 (2015).

U.S. Appl. No. 15/349,829, filed Nov. 11, 2016 (pending).
U.S. Appl. No. 15/392,913, filed Dec. 28, 2016 (pending).
U.S. Appl. No. 15/400,436, filed Jan. 6, 2017 (pending).

\* cited by examiner

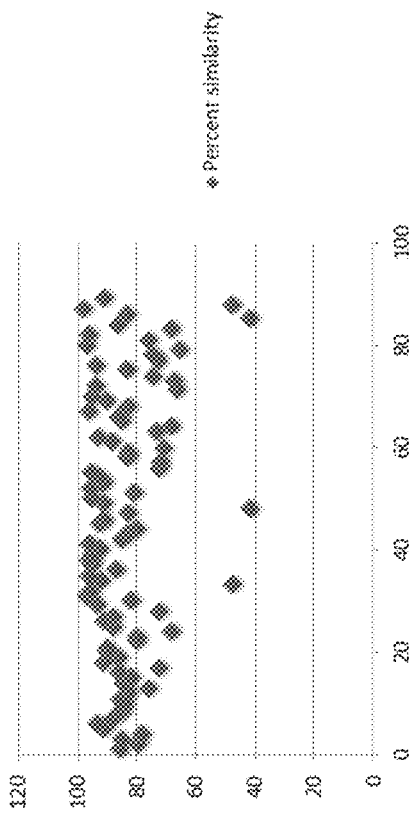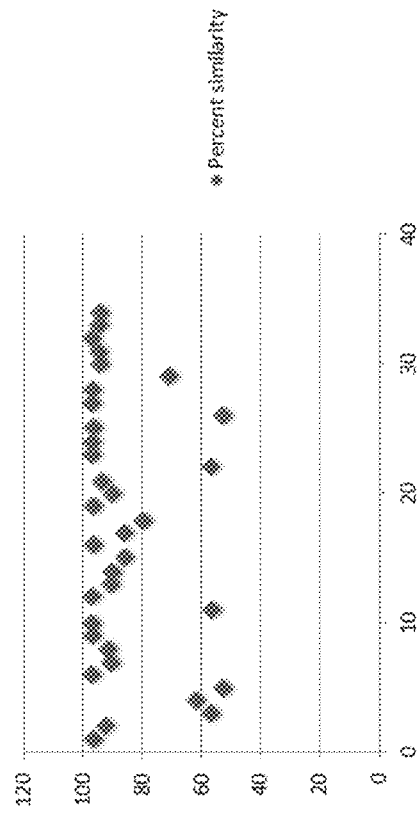

METHODS OF IMPROVING MILK PRODUCTION AND COMPOSITIONAL CHARACTERISTICS

CROSS-REFERENCE TO RELATED APPLICATIONS

This application claims the benefit of priority to U.S. Provisional Application No. 62/276,142, filed Jan. 7, 2016; U.S. Provisional Application No. 62/276,531, filed Jan. 8, 2016; U.S. Provisional Application No. 62/334,816, filed May 11, 2016; and U.S. Provisional Application No. 62/415,908, filed Nov. 1, 2016; each of which is herein incorporated by reference in its entirety.

FIELD

The present disclosure relates to isolated and biologically pure microorganisms that have applications, inter alia, in dairy production. The disclosed microorganisms can be utilized in their isolated and biologically pure states, as well as being formulated into compositions. Furthermore, the disclosure provides microbial consortia, containing at least two members of the disclosed microorganisms, as well as methods of utilizing said consortia. Furthermore, the disclosure provides for methods of modulating the rumen microbiome.

STATEMENT REGARDING SEQUENCE LISTING

The sequence listing associated with this application is provided in text format in lieu of a paper copy, and is hereby incorporated by reference into the specification. The name of the text file containing the sequence listing is ASBI_002_02US_SeqList_ST25.txt. The text file is 893 kb, was created on Oct. 31, 2016, and is being submitted electronically via EFS-Web.

BACKGROUND

The global population is predicted to increase to over 9 billion people by the year 2050 with a concurrent reduction in the quantity of land, water, and other natural resources available per capita. Projections indicate that the average domestic income will also increase, with the projected rise in the GDP of China and India. The desire for a diet richer in animal-source proteins rises in tandem with increasing income, thus the global livestock sector will be charged with the challenge of producing more milk using fewer resources. The Food and Agriculture Organization of the United Nations predict that 70% more food will have to be produced, yet the area of arable land available will decrease. It is clear that the food output per unit of resource input will have to increase considerably in order to support the rise in population.

Milk and milk components from lactating ruminants are predominantly utilized in the preparation of foodstuffs in many different forms. Nevertheless, milk and milk components find numerous alternative applications in non-food areas such as the manufacture of glues, textile fibers, plastic materials, or in the production of ethanol or methane. There have been many strategies to improve milk production and content in ruminants through nutritional modulations, hormone treatments, changes in animal management, and selective breeding; however, the need for more efficient production of milk and milk components per animal is required.

Identifying compositions and methods for sustainably increasing milk production and modulating milk components of interest while balancing animal health and wellbeing have become imperative to satisfy the needs of every day humans in an expanding population. Increasing the worldwide production of milk and further modulating desirable milk components by scaling up the total number of livestock on dairy farms would not only be economically infeasible for many parts of the world, but would further result in negative environmental consequences.

Thus, meeting global milk and milk component yield expectations, by simply scaling up current high-input agricultural systems—utilized in most of the developed world—is simply not feasible.

There is therefore an urgent need in the art for improved methods of increasing milk production and further increasing yield of desirable milk components.

SUMMARY OF THE DISCLOSURE

In some aspects, the present disclosure provides isolated microbes, including novel strains of microbes, presented in Table 1 and/or Table 3.

In other aspects, the present disclosure provides isolated whole microbial cultures of the microbes identified in Table 1 and Table 3. These cultures may comprise microbes at various concentrations.

In some aspects, the disclosure provides for utilizing one or more microbes selected from Table 1 and/or Table 3 to increase a phenotypic trait of interest in a ruminant. Furthermore, the disclosure provides for methods of modulating the rumen microbiome by utilizing one or more microbes selected from Table 1 and/or Table 3.

In some embodiments, a microbial consortium comprises at least two microbial strains selected from Table 1 and/or Table 3. In some embodiments, a microbial consortium comprises at least one microbial strain selected from Table 1 and/or Table 3. In a further embodiment, a microbial consortium comprises at least two microbial strains, wherein each microbe comprise a 16S rRNA sequence encoded by a sequence selected from SEQ ID NOs:1-30 and 2045-2103 or an ITS sequence selected from SEQ ID NOs:31-60 and 2104-2107. In an additional embodiment, a microbial consortium comprises at least one microbial strain, wherein each microbe comprise a 16S rRNA sequence encoded by a sequence selected from SEQ ID NOs:1-30 and 2045-2103, or an ITS sequence selected from SEQ ID NOs:31-60 and 2104-2107.

In some embodiments, the microbial consortia of the present disclosure comprise at least two microbial strains, wherein each microbe comprises a 16S rRNA sequence encoded by a sequence selected from SEQ ID NOs:1-30, SEQ ID NOs:61-1988, or SEQ ID NOs:2045-2103; or an ITS sequences selected from SEQ ID NOs:31-60, SEQ ID NOs:1989-2044, or SEQ ID NOs:2104-2107.

In one embodiment, the microbial consortium comprises at least two microbial strains comprising Ascusb_7, Ascusb_32, Ascusf_45, and Ascusf_24. In a further embodiment, the microbial consortium comprises at least one microbial strain comprising Ascusb_7, Ascusb_32, Ascusf_45, and Ascusf_24. In one embodiment, the microbial consortium comprises at least two microbial strains comprising Ascusb_7, Ascusb_32, Ascusf_45, and Ascusf_24. In a further embodiment, the microbial consortium comprises at least one microbial strain comprising Ascusb_7, Ascusb_32, Ascusf_45, and Ascusf_24. In one embodiment, the microbial consortium comprises at least two microbial strains comprising Ascusb_7, Ascusb_1801, Ascusf_45, and Ascusf_24. In a further embodiment, the microbial consortium comprises at least one microbial strain comprising Ascusb_7, Ascusb_1801, Ascusf_45, and Ascusf_24. In one embodiment, the microbial consortium comprises at least two microbial strains comprising Ascusb_7, Ascusb_268, Ascusf_45, and Ascusf_24. In a further embodiment, the microbial consortium comprises at least one microbial strain comprising Ascusb_7, Ascusb_268, Ascusf_45, and Ascusf_24. In one embodiment, the microbial consortium comprises at least two microbial strains comprising Ascusb_7, Ascusb_232, Ascusf_45, and Ascusf_24. In a further embodiment, the microbial consortium comprises at least one microbial strain comprising Ascusb_7, Ascusb_232, Ascusf_45, and Ascusf_24. In one embodiment, the microbial consortium comprises at least two microbial strains comprising Ascusb_7, Ascusb_32, Ascusf_45, and Ascusf_249. In a further embodiment, the microbial consortium comprises at least one microbial strain comprising Ascusb_7, Ascusb_32, Ascusf_45, and Ascusf_249. In one embodiment, the microbial consortium comprises at least two microbial strains comprising Ascusb_7, Ascusb_32, Ascusf_45, and Ascusf_353. In a further embodiment, the microbial consortium comprises at least one microbial strain comprising Ascusb_7, Ascusb_32, Ascusf_45, and Ascusf_353. In one embodiment, the microbial consortium comprises at least two microbial strains comprising Ascusb_7, Ascusb_32, Ascusf_45, and Ascusf_23. In a further embodiment, the microbial consortium comprises at least two microbial strains comprising Ascusb_7, Ascusb_32, Ascusf_45, and Ascusf_23. In one embodiment, the microbial consortium comprises at least two microbial strains comprising Ascusb_3138 and Ascusf_15. In a further embodiment, the microbial consortium comprises at least one microbial strain comprising Ascusb_3138 and Ascusf_15. In one embodiment, the at least one microbial strain comprises Ascusb_3138. In another embodiment, the at least one microbial strain comprises Ascusf_15.

In one embodiment, a composition comprises a microbial consortium of the present disclosure and an acceptable carrier. In a further embodiment, a composition comprises a microbial consortium of the present disclosure and acceptable carrier. In a further embodiment, the microbial consortium is encapsulated. In a further embodiment, the encapsulated microbial consortium comprises a polymer. In a further embodiment, the polymer may be selected from a saccharide polymer, agar polymer, agarose polymer, protein polymer, sugar polymer, and lipid polymer.

In some embodiments, the acceptable carrier is selected from the group consisting of edible feed grade material, mineral mixture, water, glycol, molasses, and corn oil. In some embodiments, the at least two microbial strains forming the microbial consortium are present in the composition at $10^2$ to $10^{15}$ cells per gram of said composition.

In some embodiments, the composition may be mixed with livestock feed.

In some embodiments, a method of imparting at least one improved trait upon an animal comprises administering the composition to the animal. In further embodiments, the animal is a ruminant, which may further be a cow.

In some embodiments, the composition is administered at least once per day. In a further embodiment, the composition is administered at least once per month. In a further embodiment, the composition is administered at least once per week. In a further embodiment, the composition is administered at least once per hour.

In some embodiments, the administration comprises injection of the composition into the rumen. In some embodiments, the composition is administered anally. In further embodiments, anal administration comprises inserting a suppository into the rectum. In some embodiments, the composition is administered orally. In some aspects, the oral administration comprises administering the composition in combination with the animal's feed, water, medicine, or vaccination. In some aspects, the oral administration comprises applying the composition in a gel or viscous solution to a body part of the animal, wherein the animal ingests the composition by licking. In some embodiments, the administration comprises spraying the composition onto the animal, and wherein the animal ingests the composition. In some embodiments, the administration occurs each time the animal is fed. In some embodiments, the oral administration comprises administering the composition in combination with the animal feed.

In some embodiments, the at least one improved trait is selected from the group consisting of: an increase of fat in milk, an increase of carbohydrates in milk, an increase of protein in milk, an increase of vitamins in milk, an increase of minerals in milk, an increase in milk volume, an improved efficiency in feed utilization and digestibility, an increase in polysaccharide and lignin degradation, an increase in fatty acid concentration in the rumen, pH balance in the rumen, a reduction in methane emissions, a reduction in manure production, improved dry matter intake, an increase in energy corrected milk (ECM) by weight and/or volume, an improved efficiency of nitrogen utilization, and any combination thereof; wherein said increase or reduction is determined by comparing against an animal not having been administered said composition.

In some embodiments, the increase in fat in milk is an increase in triglycerides, triacylglycerides, diacylglycerides, monoacylglycerides, phospholipids, cholesterol, glycolipids, and/or fatty acids. In some embodiments, an increase of carbohydrates is an increase in oligosaccharides, lactose, glucose, and/or glucose. In some embodiments, an increase in polysaccharide degradation is an increase in the degradation of cellulose, lignin, and/or hemicellulose. In some embodiments, an increase in fatty acid concentration is an increase in acetic acid, propionic acid, and/or butyric acid.

In some embodiments, the at least two microbial strains or the at least one microbial strain present in a composition, or consortia, of the disclosure exhibit an increased utility that is not exhibited when said strains occur alone or when said strains are present at a naturally occurring concentration. In some embodiments, compositions of the disclosure, comprising at least two microbial strains as taught herein, exhibit a synergistic effect on imparting at least one improved trait in an animal. In some embodiments, the compositions of the disclosure—comprising one or more isolated microbes as taught herein—exhibit markedly different characteristics/properties compared to their closest naturally occurring counterpart. That is, the compositions of the disclosure exhibit markedly different functional and/or structural characteristics/properties, as compared to their closest naturally occurring counterpart. For instance, the microbes of the disclosure are structurally different from a microbe as it naturally exists in a rumen, for at least the following reasons: said microbe can be isolated and purified, such that it is not found in the milieu of the rumen, said microbe can be present at concentrations that do not occur in the rumen, said microbe can be associated with acceptable carriers that do not occur in the rumen, said microbe can be formulated to be shelf-stable and exist outside the rumen environment, and said microbe can be combined with other microbes at concentrations that do not exist in the rumen. Further, the microbes of the disclosure are functionally different from a microbe as it naturally exists in a rumen, for at least the following reasons: said microbe when applied in an isolated and purified form can lead to modulation of the rumen microbiome, increased milk production, and/or improved milk compositional characteristics, said microbe can be formulated to be shelf-stable and able to exist outside the rumen environment, such that the microbe now has a new utility as a supplement capable of administration to a ruminant, wherein the microbe could not have such a utility in it's natural state in the rumen, as the microbe would be unable to survive outside the rumen without the intervention of the hand of man to formulate the microbe into a shelf-stable state and impart this new utility that has the aforementioned functional characteristics not possessed by the microbe in it's natural state of existence in the rumen.

In one embodiment, the disclosure provides for a ruminant feed supplement capable of increasing a desirable phenotypic trait in a ruminant. In a particular embodiment, the ruminant feed supplement comprises: a microbial consortium of the present disclosure at a concentration that does not occur naturally, and an acceptable carrier. In one aspect, the microbial consortium is encapsulated.

In one embodiment, an isolated microbial strain is selected from any one of the microbial strains in Table 1 and/or Table 3. In one embodiment, an isolated microbial strain is selected from the group consisting of: Ascusb_7 deposited as Bigelow Accession Deposit No. Patent201612011; Ascusb_32 deposited as Bigelow Accession Deposit No. Patent201612007; Ascusb_82 deposited as Bigelow Accession Deposit No. Patent201612012; Ascusb_119 deposited as Bigelow Accession Deposit No. Patent201612009; Ascusb_1801 deposited as Bigelow Accession Deposit No. Patent201612009; Ascusf_206 deposited as Bigelow Accession Deposit No. Patent201612003; Ascusf_23 deposited as Bigelow Accession Deposit No. Patent201612014; Ascusf_24 deposited as Bigelow Accession Deposit No. Patent201612004; Ascusf_45 deposited as Bigelow Accession Deposit No. Patent201612002; Ascusf_208 deposited as Bigelow Accession Deposit No. Patent201612003; Ascusb_3138 deposited as NRRL Accession Deposit No. B-67248; and Ascusf_15 deposited as NRRL Accession Deposit No. Y-67249.

In one embodiment, an isolated microbial strain of the present disclosure comprises a polynucleotide sequence sharing at least 90% sequence identity with any one of SEQ ID NOs:1-2107. In another embodiment, an isolated microbial strain of the present disclosure comprises a polynucleotide sequence sharing at least 90% sequence identity with any one of SEQ ID NOs:1-60 and 2045-2107.

In one embodiment, a substantially pure culture of an isolated microbial strain may comprise any one of the strains or microbes of the present disclosure.

In one embodiment, a method of modulating the microbiome of a ruminant comprises administering a composition of the present disclosure. In a further embodiment, the administration of the composition imparts at least one improved train upon the ruminant. In one embodiment, the at least one improved trait is selected from the group consisting of: an increase of fat in milk, an increase of carbohydrates in milk, an increase of protein in milk, an increase of vitamins in milk, an increase of minerals in milk, an increase in milk volume, an improved efficiency in feed utilization and digestibility, an increase in polysaccharide and lignin degradation, an increase in fatty acid concentration in the rumen, pH balance in the rumen, a reduction in methane emissions, a reduction in manure production, improved dry matter intake, an increase in energy corrected milk (ECM) by weight and/or volume, and an improved efficiency of nitrogen utilization; wherein said increase or reduction is determined by comparing against an animal not having been administered said composition. In an additional embodiment, the modulation of the microbiome is a decrease in the proportion of the microbial strains present in the microbiome prior to the administration of the composition, wherein the decrease is measured relative to the microbiome of the ruminant prior to the administration of the composition.

In one embodiment, the method of increasing fat in milk is an increase in triglycerides, triacylglycerides, diacylglycerides, monoacylglycerides, phospholipids, cholesterol, glycolipids, and/or fatty acids.

In one embodiment, the method of increasing carbohydrates is an increase in oligosaccharides, lactose, glucose, and/or galactose.

In one embodiment, the method of increasing polysaccharide degradation is an increase in the degradation of lignin, cellulose, pectin and/or hemicellulose.

In one embodiment, the method of increasing fatty acid concentration is an increase in acetic acid, propionic acid, and/or butyric acid.

In one embodiment, the method of modulation of the microbiome is an increase in the proportion of the at least one microbial strain of the microbiome, wherein the increase is measured relative to a ruminant that did not have the at least one microbial strain administered.

In one embodiment, the method of modulation of the microbiome is a decrease in the proportion of the microbial strains present in the microbiome prior to the administration of the composition, wherein the decrease is measured relative to the microbiome of the ruminant prior to the administration of the composition.

In one embodiment, a method of increasing resistance of cows to the colonization of pathogenic microbes comprises administering a composition of the present disclosure, resulting in the pathogenic microbes being unable to colonize the gastrointestinal tract of a cow. In another embodiment, a method for treating cows for the presence of at least one pathogenic microbe comprises the administration of a microbial consortium of the present disclosure and an acceptable carrier. In a further embodiment, the administration of the microbial consortium or microbial composition results in the relative abundance of the at least one pathogenic microbe to decrease to less than 5% relative abundance in the gastrointestinal tract. In another embodiment, the administration of the microbial consortium or microbial composition results in the relative abundance of the at least one pathogenic microbe to decrease to less than 1% relative abundance in the gastrointestinal tract. In another embodiment, the administration of the microbial consortium or microbial composition results in the pathogenic microbe being undetectable in the gastrointestinal tract.

In one embodiment, the microbial compositions and/or consortium comprise bacteria and/or fungi in spore form. In one embodiment, the microbial compositions and/or consortium of the disclosure comprise bacteria and/or fungi in whole cell form. In one embodiment, the microbial compositions and/or consortium of the disclosure comprise bacteria and/or fungi in lysed cell form. In some aspects of formulating microbes according to the disclosure, the microbes are: fermented→filtered→centrifuged→lyophilized or spray dried→and optionally coated (i.e. a "fluidized bed step").

Budapest Treaty on the International Recognition of the Deposit of Microorganisms for the Purpose of Patent Procedures Some microorganisms described in this Application were deposited on Apr. 25, 2016[1], with the United States Department of Agriculture (USDA) Agricultural Research Service (ARS) Culture Collection (NRRL®), located at 1815 N. University St., Peoria, Ill. 61604, USA. Some microorganisms described in this application were deposited with the Bigelow National Center for Marine Algae and Microbiota, located at 60 Bigelow Drive, East Boothbay, Me. 04544, USA.

[1] ASC-01 (NRRL B-67248) and ASC-02 (NRRL Y-67249) were deposited on this date

The deposits were made under the terms of the Budapest Treaty on the International Recognition of the Deposit of Microorganisms for the Purposes of Patent Procedure. The NRRL® and/or Bigelow National Center for Marine Algae and Microbiota accession numbers for the aforementioned Budapest Treaty deposits are provided in Table 3. The accession numbers and corresponding dates of deposit for the microorganisms described in this Application are separately provided in Table 25.

The strains designated in the below tables have been deposited in the labs of Ascus Biosciences, Inc. since at least Dec. 15, 2015.

In Table 1, the closest predicted hits for taxonomy of the microbes are listed in columns 2, and 5. Column 2 is the top taxonomic hit predicted by BLAST, and column 5 is the top taxonomic hit for genus+species predicted by BLAST. The strains designated in the below table have been deposited in the labs of Ascus Biosciences, Inc. since at least Dec. 15, 2015.

TABLE 1

Microbes of the present disclosure, including bacteria (1-89) and fungi (90-123).

| Predicted Taxa of Isolated Microbes | BLAST Taxonomic Top Hit | Blast % Ident. | Query Cover | BLAST Taxonomic Top Hit w/Genus + Species | Blast % Identity | Query Cover | Strain Designation | Sequence Identifier for Associated Marker | MIC Score |
|---|---|---|---|---|---|---|---|---|---|
| 1. *Clostridium* IV (Cluster) | Clostridiaceae bacterium | 96% | 100% | *Ruminococcus bromii* | 91% | 82% | Ascusb_5 | SEQ ID NO: 1 | 0.85694 |
| 2. *Ruminococcus* (Genus) | Rumen bacterium | 93% | 84% | *Ruminococcus bromii* | 91% | 82% | Ascusb_7 | SEQ ID NO: 2 | 0.97384 |
| 3. *Clostridium* IV (Cluster) | Rumen bacterium NK4A214 | 89% | 97% | *Intestinimonas butyriciproducens* | 85% | 100% | Ascusb_26 | SEQ ID NO: 3 | 0.82051 |
| 4. *Roseburia* (Genus) | Lachno- spiraceae bacterium | 89% | 100% | *Pseudobutyrivibrio ruminis* | 89% | 96% | Ascusb_27 | SEQ ID NO: 4 | 0.87214 |
| 5. *Hydrogenoanaerobacterium* (Genus) | Lachno- spiraceae bacterium | 87% | 93% | *Roseburia inulinivorans* | 86% | 93% | Ascusb_32 | SEQ ID NO: 5 | 0.81269 |
| 6. *Clostridium* XIVa (Cluster) | *Eubacterium ventriosum* | 92% | 100% | *Eubacterium ventriosum* | 92% | 100% | Ascusb_79 | SEQ ID NO: 6 | 0.82765 |
| 7. *Saccharofermentans* (Genus) | Rumen bacterium | 87% | 100% | *Faecalibacterium prausnitzii* | 91% | 76% | Ascusb_82 | SEQ ID NO: 7 | 0.93391 |
| 8. *Saccharofermentans* (Genus) | *Saccharofermentans* sp. | 100% | 99% | *Saccharofermentans acetigenes* | 83% | 92% | Ascusb_102 | SEQ ID NO: 8 | 0.82247 |
| 9. *Butyricicoccus* (Genus) | *Clostridium* sp. | 87% | 100% | *Ruminococcus flavefaciens* | 86% | 99% | Ascusb_89 | SEQ ID NO: 9 | 0.74361 |
| 10. *Papillibacter* (Genus) | Rumen bacterium NK4A214 | 91% | 99% | *Clostridium saccharolyticum* | 88% | 82% | Ascusb_111 | SEQ ID NO: 10 | 0.82772 |
| 11. *Ruminococcus* (Genus) | Ruminococcaceae bacterium | 100% | 94% | *Clostridium lentocellum* | 85% | 99% | Ascusb_119 | SEQ ID NO: 11 | 0.8263 |
| 12. *Hydrogenoanaerobacterium* (Genus) | Rumen bacterium NK4B29 | 85% | 98% | *Ruminococcus flavefaciens* | 85% | 100% | Ascusb_145 | SEQ ID NO: 12 | 0.81161 |
| 13. *Pelotomaculum* (Genus) | *Faecalibacterium* sp. | 86% | 93% | *Faecalibacterium prausnitzii* | 86% | 82% | Ascusb_205 | SEQ ID NO: 13 | 0.81461 |
| 14. *Saccharofermentans* (Genus) | Bacterium MA3003 | 99% | 91% | *Saccharofermentans acetigenes* | 90% | 79% | Ascusb_232 | SEQ ID NO: 14 | 0.81428 |
| 15. Lachnospiraceae incertae sedis (Family) | Bacterium VCD3003 | 95% | 93% | *Blautia luti* | 88% | 92% | Ascusb_252 | SEQ ID NO: 15 | 0.8196 |
| 16. *Butyricicoccus* sensu stricto (Genus) | Ruminococcaceae bacterium | 91% | 77% | *Clostridium lentocellum* | 83% | 99% | Ascusb_268 | SEQ ID NO: 16 | 0.74813 |
| 17. Lachnospiraceae incertae sedis (Family) | Bacterium YAB2006 | 96% | 92% | *Coprococcus catus* | 88% | 100% | Ascusb_374 | SEQ ID NO: 17 | 0.76214 |
| 18. *Anaeroplasma* (Genus) | *Anaeroplasma varium* | 97% | 100% | *Anaeroplasma varium* | 97% | 100% | Ascusb_411 | SEQ ID NO: 18 | 0.76213 |
| 19. *Clostridium* sensu stricto (Genus) | Clostridiales bacterium | 100% | 93% | *Clostridium stercorarium* | 81% | 91% | Ascusb_546 | SEQ ID NO: 19 | 0.83869 |
| 20. *Butyricicoccus* (Genus) | Clostridiales bacterium | 88% | 91% | *Aminiphilus circumscriptus* | 80% | 77% | Ascusb_672 | SEQ ID NO: 20 | 0.74829 |
| 21. *Butyricicoccus* (Genus) | Clostridiales bacterium | 89% | 89% | *Aminiphilus circumscriptus* | 97% | 27% | Ascusb_765 | SEQ ID NO: 21 | 0.74111 |

TABLE 1-continued

Microbes of the present disclosure, including bacteria (1-89) and fungi (90-123).

| Predicted Taxa of Isolated Microbes | BLAST Taxonomic Top Hit | Blast % Ident. | Query Cover | BLAST Taxonomic Top Hit w/Genus + Species | Blast % Identity | Query Cover | Strain Designation | Sequence Identifier for Associated Marker | MIC Score |
|---|---|---|---|---|---|---|---|---|---|
| 22. *Rikenella* (Genus) | *Bacteroides* sp. | 93% | 64% | *Alistipes shahii* | 93% | 64% | Ascusb_812 | SEQ ID NO: 22 | 0.73874 |
| 23. *Tannerella* (Genus) | *Alistipes shahii* | 86% | 100% | *Alistipes shahii* | 86% | 100% | Ascusb_1295 | SEQ ID NO: 23 | 0.8365 |
| 24. *Howardella* (Genus) | Clostridiales bacterium | 85% | 100% | *Oscilibacter valericigenes* | 89% | 41% | Ascusb_1763 | SEQ ID NO: 24 | 0.75083 |
| 25. *Prevotella* (Genus) | Bacteroidetes bacterium | 97% | 95% | *Odoribacter splanchnicus* | 77% | 86% | Ascusb_1780 | SEQ ID NO: 25 | 0.89749 |
| 26. *Butyricimonas* (Genus) | Bacteroidetes bacterium | 95% | 99% | *Tannerella forsythia* | 83% | 92% | Ascusb_1801 | SEQ ID NO: 26 | 0.89664 |
| 27. *Clostridium* sensu stricto (Genus) | Bacterium XBB3002 | 96% | 93% | *Hydrogenoanaerobacterium saccharovorans* | 84% | 86% | Ascusb_1833 | SEQ ID NO: 27 | 0.73989 |
| 28. *Clostridium* sensu stricto (Genus) | *Clostridium butyricum* | 98% | 100% | *Clostridium butyricum* | 98% | 100% | Ascusb_3138 | SEQ ID NO: 28 | 0.76524 |
| 29. *Saccharofermentans* (Genus) | Rumen bacterium NK4A214 | 87% | 99% | *Faecalibacterium prausnitzii* | 90% | 76% | Ascusb_6589 | SEQ ID NO: 29 | 0.76539 |
| 30. *Lachnospiraceae incertae sedis* (Family) | *Roseburia intestinalis* | 90% | 100% | *Roseburia intestinalis* | 90% | 100% | Ascusb_7921 | SEQ ID NO: 30 | 0.86201 |
| 31. *Succinivibrio* (Genus) | *Succinivibrio dextrinosolvens* | 95% | 99% | *Succinivibrio dextrinosolvens* | 95% | 99% | Ascusb_11 | SEQ ID NO: 2045 | 0.50001 |
| 32. *Prevotella* (Genus) | Bacterium MB2027 | 100% | 93% | *Prevotella ruminicola* | 91% | | Ascusb_36 | SEQ ID NO: 2046 | 0.55431 |
| 33. *Prevotella* (Genus) | *Prevotella ruminicola* | 100% | 99% | *Prevotella ruminicola* | 100% | 99% | Ascusb_67 | SEQ ID NO: 2047 | 0.49156 |
| 34. *Prevotella* (Genus) | *Prevotella ruminicola* | 97% | 100% | *Prevotella ruminicola* | 97% | 100% | Ascusb_87 | SEQ ID NO: 2048 | 0.59635 |
| 35. *Ruminobacter* (Genus) | *Ruminobacter* sp. | 92% | 99% | *Ruminobacter amylophilus* | 92% | 100% | Ascusb_101 | SEQ ID NO: 2049 | 0.75099 |
| 36. *Syntrophococcus* (Genus) | *Blautia producta* | 91% | 100% | *Blautia producta* | 91% | 100% | Ascusb_104 | SEQ ID NO: 2050 | 0.70044 |
| 37. *Succinivibrio* (Genus) | *Succinivibrio dextrinosolvens* | 96% | 99% | *Succinivibrio dextrinosolvens* | 96% | 99% | Ascusb_125 | SEQ ID NO: 2051 | 0.44408 |
| 38. *Pseudobutyrivibrio* (Genus) | *Butyrivibrio fibrisolvens* | 99% | 100% | *Butyrivibrio fibrisolvens* | 99% | 100% | Ascusb_149 | SEQ ID NO: 2052 | 0.50676 |
| 39. *Prevotella* (Genus) | *Prevotella ruminicola* | 99% | 99% | *Prevotella ruminicola* | 99% | 99% | Ascusb_159 | SEQ ID NO: 2053 | 0.5744 |
| 40. *Prevotella* (Genus) | *Prevotella ruminicola* | 96% | 99% | *Prevotella ruminicola* | 96% | 99% | Ascusb_183 | SEQ ID NO: 2054 | 0.50204 |
| 41. *Prevotella* (Genus) | *Prevotella ruminicola* | 99% | 100% | *Prevotella ruminicola* | 99% | 100% | Ascusb_187 | SEQ ID NO: 2055 | 0.56688 |
| 42. *Prevotella* (Genus) | Bacterium XBB2006 | 100% | 94% | *Prevotella albensis* | 87% | 97% | Ascusb_190 | SEQ ID NO: 2056 | 0.56183 |
| 43. *Lachnospiraceae incertae sedis* (Family) | Lachnospiraceae bacterium | 91% | 100% | *Roseburia inulinivorans* | 89% | 100% | Ascusb_199 | SEQ ID NO: 2057 | 0.62487 |

TABLE 1-continued

Microbes of the present disclosure, including bacteria (1-89) and fungi (90-123).

| Predicted Taxa of Isolated Microbes | BLAST Taxonomic Top Hit | Blast % Ident. | Query Cover | BLAST Taxonomic Top Hit w/Genus + Species | Blast % Identity | Query Cover | Strain Designation | Sequence Identifier for Associated Marker | MIC Score |
|---|---|---|---|---|---|---|---|---|---|
| 44. *Syntrophococcus* (Genus) | *Ruminococcus gnavus* | 95% | 100% | *Ruminococcus gnavus* | 95% | 100% | Ascusb_278 | SEQ ID NO: 2058 | 0.51235 |
| 45. *Ruminobacter* (Genus) | *Ruminobacter* sp. | 100% | 99% | *Ruminobacter amylophilus* | 99% | 100% | Ascusb_329 | SEQ ID NO: 2059 | 0.4754 |
| 46. *Butyrivibrio* (Genus) | *Butyrivibrio* sp. | 100% | 100% | *Butyrivibrio hungatei* | 99% | 98% | Ascusb_368 | SEQ ID NO: 2060 | 0.60727 |
| 47. *Clostridium*_XIVa (Cluster) | *Eubacterium oxidoreducens* | 100% | 96% | *Eubacterium oxidoreducens* | 100% | 96% | Ascusb_469 | SEQ ID NO: 2061 | 0.66345 |
| 48. *Prevotella* (Genus) | Rumen bacterium NK4A111 | 99% | 99% | *Prevotella brevis* | 91% | 100% | Ascusb_530 | SEQ ID NO: 2062 | 0.44804 |
| 49. *Prevotella* (Genus) | *Prevotella* sp. | 100% | 93% | *Prevotella copri* | 100% | 93% | Ascusb_728 | SEQ ID NO: 2063 | 0.55431 |
| 50. Lachnospiraceae incertae sedis (Family) | *Eubacterium ruminantium* | 99% | 100% | *Eubacterium ruminantium* | 99% | 100% | Ascusb_756 | SEQ ID NO: 2064 | 0.72136 |
| 51. *Roseburia* (Genus) | Lachnospiraceae bacterium | 89% | 93% | [*Clostridium*] *xylanovorans* | 89% | 91% | Ascusb_810 | SEQ ID NO: 2065 | 0.65527 |
| 52. Lachnospiraceae incertae sedis (Family) | *Lachnospira pectinoschiza* | 99% | 100% | *Lachnospira pectinoschiza* | 99% | 100% | Ascusb_817 | SEQ ID NO: 2066 | 0.46512 |
| 53. *Butyrivibrio* (Genus) | *Butyrivibrio fibrisolvens* | 98% | 99% | *Butyrivibrio fibrisolvens* | 98% | 99% | Ascusb_826 | SEQ ID NO: 2067 | 0.65357 |
| 54. *Pseudobutyrivibrio* (Genus) | *Pseudobutyrivibrio* sp. | 100% | 95% | *Pseudobutyrivibrio ruminis* | 97% | 100% | Ascusb_880 | SEQ ID NO: 2068 | 0.52295 |
| 55. *Turicibacter* (Genus) | *Sinimarinibacterium flocculans* | 87% | 69% | *Sinimarinibacterium flocculans* | 87% | 69% | Ascusb_913 | SEQ ID NO: 2069 | 0.55141 |
| 56. Lachnospiraceae incertae sedis (Family) | Bacterium FB3002 | 100% | 91% | *Butyrivibrio fibrisolvens* | 90% | 100% | Ascusb_974 | SEQ ID NO: 2070 | 0.53487 |
| 57. *Pseudobutyrivibrio* (Genus) | *Pseudobutyrivibrio ruminis* | 97% | 99% | *Pseudobutyrivibrio ruminis* | 97% | 99% | Ascusb_1069 | SEQ ID NO: 2071 | 0.55299 |
| 58. *Anaerolinea* (Genus) | Chloroflexi bacterium | 88% | 99% | *Anaerolinea thermophila* | 90% | 57% | Ascusb_1074 | SEQ ID NO: 2072 | 0.50893 |
| 59. *Roseburia* (Genus) | Lachnospiraceae | 98% | 99% | *Eubacterium rectale* | 94% | 100% | Ascusb_1293 | SEQ ID NO: 2073 | 0.61745 |
| 60. *Propionibacterium* (Genus) | *Propionibacterium acnes* | 100% | 100% | *Propionibacterium acnes* | 100% | 100% | Ascusb_1367 | SEQ ID NO: 2074 | 0.54046 |
| 61. *Clostridium*_XIVa (Cluster) | Lachnospiraceae bacterium | 88% | 100% | *Pseudobutyrivibrio ruminis* | 86% | 97% | Ascusb_1632 | SEQ ID NO: 2075 | 0.46826 |
| 62. *Olsenella* (Genus) | Coriobacteriaceae bacterium | 98% | 100% | *Olsenella profusa* | 97% | 100% | Ascusb_1674 | SEQ ID NO: 2076 | 0.51533 |
| 63. *Streptococcus* (Genus) | *Streptococcus dentirousetti* | 95% | 82% | *Streptococcus dentirousetti* | 95% | 82% | Ascusb_1786 | SEQ ID NO: 2077 | 0.48678 |
| 64. *Clostridium*_XIVa (Cluster) | *Butyrivibrio* sp. | 99% | 96% | *Butyrivibrio proteoclasticus* | 93% | 100% | Ascusb_1812 | SEQ ID NO: 2078 | 0.64367 |
| 65. *Clostridium*_XIVa (Cluster) | Bacterium DAZ2002 | 99% | 91% | *Butyrivibrio hungatei* | 96% | 99% | Ascusb_1850 | SEQ ID NO: 2079 | 0.57807 |

TABLE 1-continued

Microbes of the present disclosure, including bacteria (1-89) and fungi (90-123).

| Predicted Taxa of Isolated Microbes | BLAST Taxonomic Top Hit | Blast % Ident. | Query Cover | BLAST Taxonomic Top Hit w/Genus + Species | Blast % Identity | Query Cover | Strain Designation | Sequence Identifier for Associated Marker | MIC Score |
|---|---|---|---|---|---|---|---|---|---|
| 66. *Roseburia* (Genus) | Lachnospiraceae bacterium | 95% | 99% | *Eubacterium oxidoreducens* | 89% | 100% | Ascusb_1879 | SEQ ID NO: 2080 | 0.45014 |
| 67. *Clostridium_IV* (Cluster) | Ruminococcaceae bacterium | 87% | 99% | *Ruminococcus bromii* | 85% | 91% | Ascusb_2090 | SEQ ID NO: 2081 | 0.75266 |
| 68. *Clostridium_XICa* (Cluster) | Bacterium MA2020 | 99% | 99% | *Clostridium algidixylanolyticum* | 85% | 90% | Ascusb_2124 | SEQ ID NO: 2082 | 0.4673 |
| 69. *Lachnospiracea incertae sedis* (Family) | Bacterium YSB2008 | 94% | 94% | *Eubacterium ruminantium* | 91% | 100% | Ascusb_2198 | SEQ ID NO: 2083 | 0.55249 |
| 70. *Erysipelotrichaceae incertae sedis* (Family) | *Catenisphaera adipataccumulans* | 90% | 91% | *Catenisphaera adipataccumulans* | 90% | 91% | Ascusb_2511 | SEQ ID NO: 2084 | 0.50619 |
| 71. *Solobacterium* (Genus) | Erysipelotrichaceae bacterium | 92% | 99% | *Solobacterium moorei* | 91% | 100% | Ascusb_2530 | SEQ ID NO: 2085 | 0.53735 |
| 72. *Lachnospiraceae incertae sedis* (Genus) | *Eubacterium ruminantium* | 95% | 100% | *Eubacterium ruminantium* | 95% | 100% | Ascusb_2597 | SEQ ID NO: 2086 | 0.52028 |
| 73. *Clostridium XIVa* (Cluster) | *Butyrivibrio proteoclasticus* | 99% | 100% | *Butyrivibrio proteoclasticus* | 99% | 100% | Ascusb_2624 | SEQ ID NO: 2087 | 0.55465 |
| 74. *Ralstonia* (Genus) | *Ralstonia* sp. 94 | 100% | 99% | *Ralstonia insidiosa* | 99% | 100% | Ascusb_2667 | SEQ ID NO: 2088 | 0.52371 |
| 75. *Clostridium_XIVa* (Cluster) | *Butyrivibrio* sp. | 97% | 94% | *Butyrivibrio proteoclasticus* | 95% | 100% | Ascusb_2836 | SEQ ID NO: 2089 | 0.43374 |
| 76. *Eubacterium* (Genus) | Eubacteriaceae bacterium | 84% | 100% | *Casaltella massiliensis* | 87% | 82% | Ascusb_3003 | SEQ ID NO: 2090 | 0.56301 |
| 77. *Lachnobacterium* (Genus) | Rumen bacterium | 89% | 98% | *Eubacterium xylanophilum* | 90% | 91% | Ascusb_3504 | SEQ ID NO: 2091 | 0.52856 |
| 78. *Acholeplasma* (Genus) | *Acholeplasma brassicae* | 86% | 72% | *Acholeplasma brassicae* | 86% | 72% | Ascusb_3881 | SEQ ID NO: 2092 | 0.4402 |
| 79. *Selenomonas* (Genus) | *Mitsuokella jalaludinii* | 91% | 97% | *Mitsuokella jalaludinii* | 91% | 97% | Ascusb_4728 | SEQ ID NO: 2093 | 0.4761 |
| 80. *Prevotella* (Genus) | *Prevotella ruminicola* | 98% | 100% | *Prevotella ruminicola* | 98% | 100% | Ascusb_4934 | SEQ ID NO: 2094 | 0.56204 |
| 81. *Clostridium_XIVa* (Cluster) | *Butyrivibrio* sp. | 99% | 99% | *Butyrivibrio fibrisolvens* | 97% | 100% | Ascusb_4959 | SEQ ID NO: 2095 | 0.42892 |
| 82. *Succinivibrio* (Genus) | *Succinivibrio dextrinosolvens* | 86% | 84% | *Succinivibrio dextrinosolvens* | 86% | 84% | Ascusb_5525 | SEQ ID NO: 2096 | 0.51758 |
| 83. *Ruminobacter* (Genus) | *Ruminobacter* sp. | 100% | 99% | *Ruminobacter amylophilus* | 99% | 100% | Ascusb_12103 | SEQ ID NO: 2097 | 0.52909 |
| 84. *Sharpea* (Genus) | Lachnospiraceae bacterium | 97% | 100% | *Sharpea azabuensis* | 100% | 91% | Ascusb_14245 | SEQ ID NO: 2098 | 0.61391 |
| 85. *Prevotella* (Genus) | *Prevotella ruminicola* | 87% | 97% | *Prevotella ruminicola* | 87% | 97% | Ascusb_14945 | SEQ ID NO: 2099 | 0.80101 |
| 86. *Prevotella* (Genus) | *Prevotella* sp. DJF | 88% | 89% | *Prevotella ruminicola* | 87% | 945 | Ascusb_17461 | SEQ ID NO: 2100 | 0.44777 |
| 87. *Prevotella* (Genus) | Bacterium MB2027 | 100% | 93% | *Prevotella ruminicola* | 91% | 99% | Ascusb_20083 | SEQ ID NO: 2101 | 0.52538 |

TABLE 1-continued

Microbes of the present disclosure, including bacteria (1-89) and fungi (90-123).

| Predicted Taxa of Isolated Microbes | BLAST Taxonomic Top Hit | Blast % Ident. | Query Cover | BLAST Taxonomic Top Hit w/Genus + Species | Blast % Identity | Query Cover | Strain Designation | Sequence Identifier for Associated Marker | MIC Score |
|---|---|---|---|---|---|---|---|---|---|
| 88. *Prevotella* (Genus) | *Prevotella ruminicola* | 99% | 100% | *Prevotella ruminicola* | 99% | 100% | Ascusb_20187 | SEQ ID NO: 2102 | 0.59156 |
| 89. *Prevotella* (Genus) | *Prevotella ruminicola* | 100% | 100% | *Prevotella ruminicola* | 100% | 100% | Ascusb_20539 | SEQ ID NO: 2103 | 0.4912 |
| 90. *Piromyces* (Genus) | *Piromyces* sp. | 93% | 100% | *Neocallimastix frontalis* | 84% | 100% | Ascusf_11 | SEQ ID NO: 31 | 0.81719 |
| 91. *Candida xylopsoc* (Genus + Species) | *Pichia kudriavzevii* | 100% | 100% | *Pichia kudriavzevii* | 100% | 100% | Ascusf_15 | SEQ ID NO: 32 | 0.76088 |
| 92. *Orpinomyces* (Genus) | *Orpinomyces* sp. | 100% | 100% | *Neocallimastix frontalis* | 86% | 100% | Ascusf_22 | SEQ ID NO: 33 | 0.76806 |
| 93. *Orpinomyces* (Genus) | *Neocallimastix frontalis* | 86% | 80% | *Neocallimastix frontalis* | 86% | 80% | Ascusf_23 | SEQ ID NO: 34 | 0.85707 |
| 94. *Orpinomyces* (Genus) | *Orpinomyces* sp. | 95% | 100% | *Neocallimastix frontalis* | 86% | 100% | Ascusf_24 | SEQ ID NO: 35 | 0.85292 |
| 95. *Candida apicol* (Genus + Species) | *Candida apicola* | 100% | 100% | *Candida apicola* | 100% | 100% | Ascusf_25 | SEQ ID NO: 36 | 0.70561 |
| 96. *Candida rugosa* (Genus + Species) | *Candida akabanensis* | 100% | 100% | *Candida akabanensis* | 100% | 100% | Ascusf_38 | SEQ ID NO: 37 | 0.78246 |
| 97. *Neocallimastix* (Genus) | *Neocallimastix* sp. | 99% | 100% | *Neocallimastix frontalis* | 99% | 100% | Ascusf_45 | SEQ ID NO: 38 | 0.86185 |
| 98. *Orpinomyces* (Genus) | *Orpinomyces* sp. | 99% | 100% | *Orpinomyces joyonii* | 96% | 96% | Ascusf_60 | SEQ ID NO: 39 | 0.72985 |
| 99. *Orpinomyces* (Genus) | *Neocallimastix frontalis* | 86% | 78% | *Neocallimastix frontalis* | 86% | 78% | Ascusf_73 | SEQ ID NO: 40 | 0.76064 |
| 100. *Neocallimastix* (Genus) | *Neocallimastix* sp. | 98% | 100% | *Neocallimastix frontalis* | 93% | 100% | Ascusf_77 | SEQ ID NO: 41 | 0.83475 |
| 101. *Neocallimastix* (Genus) | *Neocallimastix frontalis* | 97% | 100% | *Neocallimastix frontalis* | 97% | 100% | Ascusf_94 | SEQ ID NO: 42 | 0.77644 |
| 102. *Ascomycota* (Genus) | *Basidiomycota* sp. | 85% | 98% | *Sugiyamaella lignohabitans* | 97% | 26% | Ascusf_95 | SEQ ID NO: 43 | 0.7089 |
| 103. *Piromyces* (Genus) | *Caecomyces* sp. | 94% | 100% | *Cyllamyces aberensis* | 86% | 89% | Ascusf_108 | SEQ ID NO: 44 | 0.68405 |
| 104. *Orpinomyces* (Genus) | *Orpinomyces* sp. | 95% | 100% | *Orpinomyces joyonii* | 87% | 96% | Ascusf_119 | SEQ ID NO: 45 | 0.80055 |
| 105. *Cyllamyces* (Genus) | *Caecomyces* sp. | 90% | 100% | *Caecomyces communis* | 90% | 83% | Ascusf_127 | SEQ ID NO: 46 | 0.66812 |
| 106. *Piromyces* (Genus) | *Caecomyces* sp. | 91% | 100% | *Caecomyces communis* | 92% | 83% | Ascusf_136 | SEQ ID NO: 47 | 0.73201 |
| 107. *Cyllamyces* (Genus) | *Cyllamyces* sp. | 97% | 100% | *Cyllamyces aberensis* | 94% | 89% | Ascusf_193 | SEQ ID NO: 48 | 0.7586 |
| 108. *Piromyces* (Genus) | *Piromyces* sp. | 92% | 100% | *Neocallimastix frontalis* | 84% | 100% | Ascusf_228 | SEQ ID NO: 49 | 0.83403 |
| 109. *Piromyces* (Genus) | *Caecomyces* sp. | 94% | 100% | *Cyllamyces aberensis* | 86% | 89% | Ascusf_249 | SEQ ID NO: 50 | 0.78679 |

TABLE 1-continued

Microbes of the present disclosure, including bacteria (1-89) and fungi (90-123).

| Predicted Taxa of Isolated Microbes | BLAST Taxonomic Top Hit | Blast % Ident. | Query Cover | BLAST Taxonomic Top Hit w/Genus + Species | Blast % Identity | Query Cover | Strain Designation | Sequence Identifier for Associated Marker | MIC Score |
|---|---|---|---|---|---|---|---|---|---|
| 110. *Neocallimastix* (Genus) | *Neocallimastix* sp. | 98% | 100% | *Neocallimastix frontalis* | 92% | 100% | Ascusf_307 | SEQ ID NO: 51 | 0.77859 |
| 111. *Piromyces* (Genus) | *Piromyces* sp. | 94% | 100% | *Neocallimastix frontalis* | 83% | 100% | Ascusf_315 | SEQ ID NO: 52 | 0.81028 |
| 112. *Neocallimastix* (Genus) | *Neocallimastix* sp. | 100% | 98% | *Neocallimastix frontalis* | 100% | 90% | Ascusf_334 | SEQ ID NO: 53 | 0.76456 |
| 113. Saccharomycetales (Order) | *Candida ethanolica* | 100% | 100% | *Candida ethanolica* | 100% | 100% | Ascusf_353 | SEQ ID NO: 54 | 0.82628 |
| 114. *Piromyces* (Genus) | *Piromyces* sp. | 91% | 100% | *Neocallimastix frontalis* | 83% | 100% | Ascusf_448 | SEQ ID NO: 55 | 0.70021 |
| 115. *Orpinomyces* (Genus) | *Neocallimastix* sp. | 88% | 91% | *Neocallimastix frontalis* | 96% | 88% | Ascusf_786 | SEQ ID NO: 56 | 0.63201 |
| 116. *Piromyces* (Genus) | *Piromyces* sp. | 91% | 100% | *Neocallimastix frontalis* | 83% | 100% | Ascusf_836 | SEQ ID NO: 57 | 0.65492 |
| 117. *Phyllosticta capitalensis* (Genus + Species) | *Tremellales* sp. | 96% | 74% | *Tremella giraffa* | 83% | 96% | Ascusf_923 | SEQ ID NO: 58 | 0.76115 |
| 118. *Orpinomyces* (Genus) | *Neocallimastix frontalis* | 87% | 77% | *Neocallimastix frontalis* | 87% | 77% | Ascusf_1020 | SEQ ID NO: 59 | 0.68043 |
| 119. *Orpinomyces* (Genus) | *Neocallimastix frontalis* | 85% | 80% | *Neocallimastix frontalis* | 85% | 80% | Ascusf_1103 | SEQ ID NO: 60 | 0.73004 |
| 120. *Orpinomyces* (Genus) | Fungal sp. Tianzhu-Yak6 | 99% | 100% | *Orpinomyces joyonii* | 94% | 96% | Ascusf_81 | SEQ ID NO: 2104 | 0.44471 |
| 121. *Piromyces* (Genus) | *Piromyces* sp. | 99% | 100% | *Neocallimastix frontalis* | 84% | 100% | Ascusf_206 | SEQ ID NO: 2105 | 0.49752 |
| 122. *Piromyces* (Genus) | *Piromyces* sp. | 96% | 100% | *Neocallimastix frontalis* | 82% | 100% | Ascusf_208 | SEQ ID NO: 2106 | 0.4176 |
| 123. *Piromyces* (Genus) | *Piromyces* sp. | 99% | 100% | *Neocallimastix frontalis* | 82% | 100% | Ascusf_1012 | SEQ ID NO: 2107 | 0.55922 |

TABLE 2

Microbial Deposits Corresponding to the Microbes of Table 1

| Predicted Taxa of Isolated Microbes | Strain Designation | Sequence Identifier for Associated Marker | Deposit # | Predicted Taxa of Isolated Microbes | Strain Designation | Sequence Identifier for Associated Marker | Deposit # |
|---|---|---|---|---|---|---|---|
| *Clostridium* IV (Cluster) | Ascusb_5 | SEQ ID NO: 1 | PATENT201612001, PATENT201612007, PATENT201612009, PATENT201612010, PATENT201612011, PATENT201612012 | *Streptococcus* (Genus) | Ascusb_1786 | SEQ ID NO: 2077 | PATENT201612011, PATENT201612012, PATENT201612013 |
| *Ruminococcus* (Genus) | Ascusb_7 | SEQ ID NO: 2 | PATENT201612005, PATENT201612007, PATENT201612009, PATENT201612010, PATENT201612011, PATENT201612012, PATENT201612013 | *Clostridium*_XIVa (Cluster) | Ascusb_1812 | SEQ ID NO: 2078 | PATENT201612011, PATENT201612012 |
| *Clostridium* IV (Cluster) | Ascusb_26 | SEQ ID NO: 3 | PATENT201612005, PATENT201612009, PATENT201612011, PATENT201612012 | *Clostridium*_XIVa (Cluster) | Ascusb_1850 | SEQ ID NO: 2079 | PATENT201612013 |
| *Roseburia* (Genus) | Ascusb_27 | SEQ ID NO: 4 | PATENT201612009 | *Roseburia* (Genus) | Ascusb_1879 | SEQ ID NO: 2080 | PATENT201612007, PATENT201612009 |
| *Hydrogenoanaerobacterium* (Genus) | Ascusb_32 | SEQ ID NO: 5 | PATENT201612006, PATENT201612009, PATENT201612012 | *Clostridium*_IV (Cluster) | Ascusb_2090 | SEQ ID NO: 2081 | PATENT201612012 |
| *Clostridium* XIVa (Cluster) | Ascusb_79 | SEQ ID NO: 6 | PATENT201612011, PATENT201612012 | *Clostridium*_XICa (Cluster) | Ascusb_2124 | SEQ ID NO: 2082 | PATENT201612012 |
| *Saccharofermentans* (Genus) | Ascusb_82 | SEQ ID NO: 7 | PATENT201612005, PATENT201612006, PATENT201612007, PATENT201612009, PATENT201612010, PATENT201612012 | *Lachnospiracea* incertae sedis (Family) | Ascusb_2198 | SEQ ID NO: 2083 | PATENT201612012 |
| *Saccharofermentans* (Genus) | Ascusb_102 | SEQ ID NO: 8 | PATENT201612005, PATENT201612007, PATENT201612010, PATENT201612011, PATENT201612012 | Erysipelotrichaceae incertae sedis (Family) | Ascusb_2511 | SEQ ID NO: 2084 | PATENT201612001, PATENT201612007, PATENT201612013 |
| *Butyricicoccus* (Genus) | Ascusb_89 | SEQ ID NO: 9 | PATENT201612011, PATENT201612012 | *Solobacterium* (Genus) | Ascusb_2530 | SEQ ID NO: 2085 | PATENT201612011, PATENT201612012 |
| *Papillibacter* (Genus) | Ascusb_111 | SEQ ID NO: 10 | PATENT201612005, PATENT201612007, PATENT201612012 | Lachnospiraceae incertae sedis (Genus) | Ascusb_2597 | SEQ ID NO: 2086 | PATENT201612013 |

TABLE 2-continued

Microbial Deposits Corresponding to the Microbes of Table 1

| Predicted Taxa of Isolated Microbes | Strain Designation | Sequence Identifier for Associated Marker | Deposit # | Predicted Taxa of Isolated Microbes | Strain Designation | Sequence Identifier for Associated Marker | Deposit # |
|---|---|---|---|---|---|---|---|
| *Ruminococcus* (Genus) | Ascusb_119 | SEQ ID NO: 11 | PATENT201612011, PATENT201612012 | *Clostridium_XIVa* (Cluster) | Ascusb_2624 | SEQ ID NO: 2087 | PATENT201612009, PATENT201612011, PATENT201612012 |
| *Hydrogenoanaerobacterium* (Genus) | Ascusb_145 | SEQ ID NO: 12 | PATENT201612011, PATENT201612012 | *Ralstonia* (Genus) | Ascusb_2667 | SEQ ID NO: 2088 | PATENT201612013 |
| *Pelotomaculum* (Genus) | Ascusb_205 | SEQ ID NO: 13 | PATENT201612005, PATENT201612006, PATENT201612011, PATENT201612012 | *Clostridium_XIVa* (Cluster) | Ascusb_2836 | SEQ ID NO: 2089 | PATENT201612013 |
| *Saccharofermentans* (Genus) | Ascusb_232 | SEQ ID NO: 14 | PATENT201612010, PATENT201612011, PATENT201612012 | *Eubacterium* (Genus) | Ascusb_3003 | SEQ ID NO: 2090 | PATENT201612009 |
| Lachnospiraceae incertae sedis (Family) | Ascusb_252 | SEQ ID NO: 15 | | *Lachnobacterium* (Genus) | Ascusb_3504 | SEQ ID NO: 2091 | PATENT201612011, PATENT201612012 |
| *Butyricicoccus* sensu stricto (Genus) | Ascusb_268 | SEQ ID NO: 16 | PATENT201612007, PATENT201612011, PATENT201612012 | *Acholeplasma* (Genus) | Ascusb_3881 | SEQ ID NO: 2092 | PATENT201612007 |
| Lachnospiraceae incertae sedis (Family) | Ascusb_374 | SEQ ID NO: 17 | PATENT201612007, PATENT201612009, PATENT201612010, PATENT201612011, PATENT201612012 | *Selenomonas* (Genus) | Ascusb_4728 | SEQ ID NO: 2093 | |
| *Anaeroplasma* (Genus) | Ascusb_411 | SEQ ID NO: 18 | PATENT201612007, PATENT201612011, PATENT201612012 | *Prevotella* (Genus) | Ascusb_4934 | SEQ ID NO: 2094 | |
| *Clostridium* sensu stricto (Genus) | Ascusb_546 | SEQ ID NO: 19 | PATENT201612013 | *Clostridium_XIVa* (Cluster) | Ascusb_4959 | SEQ ID NO: 2095 | |
| *Butyricicoccus* (Genus) | Ascusb_672 | SEQ ID NO: 20 | | *Saccanivibrio* (Genus) | Ascusb_5525 | SEQ ID NO: 2096 | |
| *Butyricicoccus* (Genus) | Ascusb_765 | SEQ ID NO: 21 | PATENT201612013 | *Ruminobacter* (Genus) | Ascusb_12103 | SEQ ID NO: 2097 | PATENT201612001 |
| *Rikenella* (Genus) | Ascusb_812 | SEQ ID NO: 22 | PATENT201612005, PATENT201612006, PATENT201612011, PATENT201612012 | *Sharpea* (Genus) | Ascusb_14245 | SEQ ID NO: 2098 | PATENT201612001, PATENT201612008, PATENT201612009, PATENT201612011, PATENT201612012, PATENT201612013 |
| *Tannerella* (Genus) | Ascusb_1295 | SEQ ID NO: 23 | PATENT201612007, PATENT201612009, PATENT201612011, PATENT201612012 | *Prevotella* (Genus) | Ascusb_14945 | SEQ ID NO: 2099 | |

TABLE 2-continued

Microbial Deposits Corresponding to the Microbes of Table 1

| Predicted Taxa of Isolated Microbes | Strain Designation | Sequence Identifier for Associated Marker | Deposit # | Predicted Taxa of Isolated Microbes | Strain Designation | Sequence Identifier for Associated Marker | Deposit # |
|---|---|---|---|---|---|---|---|
| *Howardella* (Genus) | Ascusb_1763 | SEQ ID NO: 24 | PATENT201612011, PATENT201612012 | *Prevotella* (Genus) | Ascusb_17461 | SEQ ID NO: 2100 | |
| *Prevotella* (Genus) | Ascusb_1780 | SEQ ID NO: 25 | PATENT201612013 | *Prevotella* (Genus) | Ascusb_20083 | SEQ ID NO: 2101 | PATENT201612006 |
| *Butyricimonas* (Genus) | Ascusb_1801 | SEQ ID NO: 26 | PATENT201612005 | *Prevotella* (Genus) | Ascusb_20187 | SEQ ID NO: 2102 | PATENT201612009, PATENT201612011, PATENT201612012 |
| *Clostridium* sensu stricto (Genus) | Ascusb_1833 | SEQ ID NO: 27 | PATENT201612006, PATENT201612007, PATENT201612009, PATENT201612010, PATENT201612011, PATENT201612012 | *Prevotella* (Genus) | Ascusb_20539 | SEQ ID NO: 2103 | |
| *Clostridium* sensu stricto (Genus) | Ascusb_3138 | SEQ ID NO: 28 | PATENT201612005, PATENT201612006, PATENT201612008, PATENT201612009, PATENT201612010, PATENT201612011, PATENT201612012, PATENT201612013, NRRL B-67248 | *Piromyces* (Genus) | Ascusf_11 | SEQ ID NO: 31 | |
| *Saccharofermentans* (Genus) | Ascusb_6589 | SEQ ID NO: 29 | PATENT201612005 | *Candida xylopsoc* (Genus + Species) *Orpinomyces* (Genus) | Ascusf_15 | SEQ ID NO: 32 | NRRL Y-67249, PATENT201612014 |
| Lachnospiraceae incertae sedis (Family) | Ascusb_7921 | SEQ ID NO: 30 | | *Orpinomyces* (Genus) | Ascusf_22 | SEQ ID NO: 33 | PATENT201612002, PATENT201612004 |
| *Succinivibrio* (Genus) | Ascusb_11 | SEQ ID NO: 2045 | PATENT201612001, PATENT201612008, PATENT201612009, PATENT201612011, PATENT201612012 | | Ascusf_23 | SEQ ID NO: 34 | PATENT201612004 |
| *Prevotella* (Genus) | Ascusb_36 | SEQ ID NO: 2046 | PATENT201612013 | *Orpinomyces* (Genus) | Ascusf_24 | SEQ ID NO: 35 | PATENT201612002, PATENT201612004 |
| *Prevotella* (Genus) | Ascusb_67 | SEQ ID NO: 2047 | | *Candida apicol* (Genus + Species) | Ascusf_25 | SEQ ID NO: 36 | PATENT201612014 |
| *Prevotella* (Genus) | Ascusb_87 | SEQ ID NO: 2048 | | *Candida rugosa* (Genus + Species) | Ascusf_38 | SEQ ID NO: 37 | PATENT201612004 |
| *Ruminobacter* (Genus) | Ascusb_101 | SEQ ID NO: 2049 | PATENT201612001, PATENT201612005, PATENT201612011, PATENT201612012 | *Neocallimastix* (Genus) | Ascusf_45 | SEQ ID NO: 38 | PATENT201612002, PATENT201612014 |

TABLE 2-continued

Microbial Deposits Corresponding to the Microbes of Table 1

| Predicted Taxa of Isolated Microbes | Strain Designation | Sequence Identifier for Associated Marker | Deposit # | Predicted Taxa of Isolated Microbes | Strain Designation | Sequence Identifier for Associated Marker | Deposit # |
|---|---|---|---|---|---|---|---|
| Syntrophococcus (Genus) | Ascusb_104 | SEQ ID NO: 2050 | PATENT201612005, PATENT201612006 | Orpinomyces (Genus) | Ascusf_60 | SEQ ID NO: 39 | |
| Succinivibrio (Genus) | Ascusb_125 | SEQ ID NO: 2051 | PATENT201612001, PATENT201612005, PATENT201612006, PATENT201612008, PATENT201612009, PATENT201612011, PATENT201612012 | Orpinomyces (Genus) | Ascusf_73 | SEQ ID NO: 40 | |
| Pseudobutyrivibrio (Genus) | Ascusb_149 | SEQ ID NO: 2052 | PATENT201612001, PATENT201612008, PATENT201612009, PATENT201612011, PATENT201612012, PATENT201612013 | Neocallimastix (Genus) | Ascusf_77 | SEQ ID NO: 41 | PATENT201612014 |
| Prevotella (Genus) | Ascusb_159 | SEQ ID NO: 2053 | PATENT201612005, PATENT201612006, PATENT201612007, PATENT201612008, PATENT201612009, PATENT201612010, PATENT201612011, PATENT201612012 | Neocallimastix (Genus) | Ascusf_94 | SEQ ID NO: 42 | PATENT201612014 |
| Prevotella (Genus) | Ascusb_183 | SEQ ID NO: 2054 | PATENT201612008, PATENT201612009 | Ascomycota (Genus) | Ascusf_95 | SEQ ID NO: 43 | |
| Prevotella (Genus) | Ascusb_187 | SEQ ID NO: 2055 | PATENT201612007, PATENT201612008, PATENT201612010, PATENT201612011, PATENT201612012 | Piromyces (Genus) | Ascusf_108 | SEQ ID NO: 44 | PATENT201612014 |
| Prevotella (Genus) | Ascusb_190 | SEQ ID NO: 2056 | PATENT201612005, PATENT201612006, PATENT201612007, PATENT201612012 | Orpinomyces (Genus) | Ascusf_119 | SEQ ID NO: 45 | |
| Lachnospiraceae incertae sedis (Family) | Ascusb_199 | SEQ ID NO: 2057 | PATENT201612011, PATENT201612012 | Cyllamyces (Genus) | Ascusf_127 | SEQ ID NO: 46 | |
| Syntrophococcus (Genus) | Ascusb_278 | SEQ ID NO: 2058 | PATENT201612008 | Piromyces (Genus) | Ascusf_136 | SEQ ID NO: 47 | |
| Ruminobacter (Genus) | Ascusb_329 | SEQ ID NO: 2059 | PATENT201612010 | Cyllamyces (Genus) | Ascusf_193 | SEQ ID NO: 48 | |
| Butyrivibrio (Genus) | Ascusb_368 | SEQ ID NO: 2060 | PATENT201612011, PATENT201612012 | Piromyces (Genus) | Ascusf_228 | SEQ ID NO: 49 | |
| Clostridium_XIVa (Cluster) | Ascusb_469 | SEQ ID NO: 2061 | | Piromyces (Genus) | Ascusf_249 | SEQ ID NO: 50 | |

TABLE 2-continued

Microbial Deposits Corresponding to the Microbes of Table 1

| Predicted Taxa of Isolated Microbes | Strain Designation | Sequence Identifier for Associated Marker | Deposit # | Predicted Taxa of Isolated Microbes | Strain Designation | Sequence Identifier for Associated Marker | Deposit # |
|---|---|---|---|---|---|---|---|
| Prevotella (Genus) | Ascusb_530 | SEQ ID NO: 2062 | | Neocallimastix (Genus) | Ascusf_307 | SEQ ID NO: 51 | PATENT201612002, |
| Prevotella (Genus) | Ascusb_728 | SEQ ID NO: 2063 | PATENT201612008, PATENT201612009, PATENT201612011, PATENT201612012, PATENT201612013 | Piromyces (Genus) | Ascusf_315 | SEQ ID NO: 52 | PATENT201612014 |
| Lachnospiraceae incertae sedis (Family) | Ascusb_756 | SEQ ID NO: 2064 | | Neocallimastix (Genus) | Ascusf_334 | SEQ ID NO: 53 | PATENT201612014 |
| Roseburia (Genus) | Ascusb_810 | SEQ ID NO: 2065 | PATENT201612011, PATENT201612012 | Saccharomycetales (Order) | Ascusf_353 | SEQ ID NO: 54 | PATENT201612014 |
| Lachnospiraceae incertae sedis (Family) | Ascusb_817 | SEQ ID NO: 2066 | PATENT201612001, PATENT201612006, PATENT201612009, PATENT201612012, PATENT201612013, NRRL B-67349 | Piromyces (Genus) | Ascusf_448 | SEQ ID NO: 55 | |
| Butyrivibrio (Genus) | Ascusb_826 | SEQ ID NO: 2067 | PATENT201612011, PATENT201612012, PATENT201612013, NRRL B-67347 | Orpinomyces (Genus) | Ascusf_786 | SEQ ID NO: 56 | |
| Pseudobutyrivibrio (Genus) | Ascusb_880 | SEQ ID NO: 2068 | PATENT201612008, PATENT201612007, PATENT201612008, PATENT201612009, PATENT201612010, PATENT201612011, PATENT201612012 | Piromyces (Genus) | Ascusf_836 | SEQ ID NO: 57 | |
| Turicibacter (Genus) | Ascusb_913 | SEQ ID NO: 2069 | | Phyllosticta capitalensis (Genus + Species) | Ascusf_923 | SEQ ID NO: 58 | |

TABLE 2-continued

Microbial Deposits Corresponding to the Microbes of Table 1

| Predicted Taxa of Isolated Microbes | Strain Designation | Sequence Identifier for Associated Marker | Deposit # | Predicted Taxa of Isolated Microbes | Strain Designation | Sequence Identifier for Associated Marker | Deposit # |
|---|---|---|---|---|---|---|---|
| Lachnospiraceae incertae sedis (Family) | Ascusb_974 | SEQ ID NO: 2070 | PATENT201612013 | Orpinomyces (Genus) | Ascusf_1020 | SEQ ID NO: 59 | |
| Pseudobutyrivibrio (Genus) | Ascusb_1069 | SEQ ID NO: 2071 | PATENT201612011, PATENT201612012, NRRL B-67348 | Orpinomyces (Genus) | Ascusf_1103 | SEQ ID NO: 60 | |
| Anaerolinea (Genus) | Ascusb_1074 | SEQ ID NO: 2072 | PATENT201612005, PATENT201612007, PATENT201612008, PATENT201612012 | Orpinomyces (Genus) | Ascusf_81 | SEQ ID NO: 2104 | |
| Roseburia (Genus) | Ascusb_1293 | SEQ ID NO: 2073 | | Piromyces (Genus) | Ascusf_206 | SEQ ID NO: 2105 | PATENT201612003 |
| Propionibacterium (Genus) | Ascusb_1367 | SEQ ID NO: 2074 | PATENT201612007, PATENT201612009, PATENT201612012 | Piromyces (Genus) | Ascusf_208 | SEQ ID NO: 2106 | PATENT201612003 |
| Clostridium_XIVa (Cluster) | Ascusb_1632 | SEQ ID NO: 2075 | PATENT201612011, PATENT201612012 | Piromyces (Genus) | Ascusf_1012 | SEQ ID NO: 2107 | PATENT201612003 |
| Olsenella (Genus) | Ascusb_1674 | SEQ ID NO: 2076 | PATENT201612001, PATENT201612009 | | | | |

TABLE 3

Bacteria of the present disclosure.

| Predicted Closest Taxa of Isolated Microbes | Strain Designation | Sequence Identifier |
|---|---|---|
| Corynebacterium | Ascusb_3 | 61 |
| Prevotella | Ascusb_50 | 62 |
| Comamonas | Ascusb_90 | 63 |
| Clostridium_XIVa | Ascusb_117 | 64 |
| Hippea | Ascusb_171 | 65 |
| Anaerovorax | Ascusb_177 | 66 |
| Clostridium_XIVa | Ascusb_179 | 67 |
| Rummeliibacillus | Ascusb_224 | 68 |
| Clostridium_XIVa | Ascusb_234 | 69 |
| Lachnospiracea_incertae_sedis | Ascusb_274 | 70 |
| Prevotella | Ascusb_276 | 71 |
| Anaerovorax | Ascusb_293 | 72 |
| Pseudoflavonifractor | Ascusb_327 | 73 |
| Prevotella | Ascusb_337 | 74 |
| Clostridium_XIVa | Ascusb_357 | 75 |
| Clostridium_XIVa | Ascusb_357 | 76 |
| Coprococcus | Ascusb_361 | 77 |
| Pyramidobacter | Ascusb_388 | 78 |
| Syntrophococcus | Ascusb_425 | 79 |
| Prevotella | Ascusb_444 | 80 |
| Clostridium_XIVa | Ascusb_456 | 81 |
| Prevotella | Ascusb_492 | 82 |
| Roseburia | Ascusb_523 | 83 |
| Clostridium_XIVa | Ascusb_526 | 84 |
| Lachnospiracea_incertae_sedis | Ascusb_570 | 85 |
| Clostridium_XIVa | Ascusb_584 | 86 |
| Acidothermus | Ascusb_605 | 87 |
| Adlercreutzia | Ascusb_606 | 88 |
| Prevotella | Ascusb_617 | 89 |
| Lachnospiracea_incertae_sedis | Ascusb_635 | 90 |
| Proteiniclasticum | Ascusb_642 | 91 |
| Lachnospiracea_incertae_sedis | Ascusb_647 | 92 |
| Anaerovorax | Ascusb_656 | 93 |
| Prevotella | Ascusb_669 | 94 |
| Bacteroides | Ascusb_681 | 95 |
| Clostridium_III | Ascusb_704 | 96 |
| Prevotella | Ascusb_706 | 97 |
| Acinetobacter | Ascusb_717 | 98 |
| Erysipelothrix | Ascusb_752 | 99 |
| Bacteroides | Ascusb_790 | 100 |
| Clostridium_XIVa | Ascusb_797 | 101 |
| Butyrivibrio | Ascusb_802 | 102 |
| Eubacterium | Ascusb_805 | 103 |
| Prevotella | Ascusb_828 | 104 |
| Eubacterium | Ascusb_890 | 105 |
| Prevotella | Ascusb_909 | 106 |
| Lachnospiracea_incertae_sedis | Ascusb_924 | 107 |
| Coprococcus | Ascusb_955 | 108 |
| Prevotella | Ascusb_958 | 109 |
| Clostridium_XIVa | Ascusb_980 | 110 |
| Prevotella | Ascusb_982 | 111 |
| Catonella | Ascusb_990 | 112 |
| Methanobrevibacter | Ascusb_993 | 113 |
| Ruminococcus | Ascusb_1013 | 114 |
| Lachnospiracea_incertae_sedis | Ascusb_1021 | 115 |
| Coprococcus | Ascusb_1033 | 116 |
| Clostridium_XIVa | Ascusb_1090 | 117 |
| Lachnospiracea_incertae_sedis | Ascusb_1108 | 118 |
| Prevotella | Ascusb_1113 | 119 |
| Anaerovorax | Ascusb_1114 | 120 |
| Asteroleplasma | Ascusb_1116 | 121 |
| Clostridium_XIVa | Ascusb_1118 | 122 |
| Caulobacter | Ascusb_1123 | 123 |
| Lachnospiracea_incertae_sedis | Ascusb_1128 | 124 |
| Roseburia | Ascusb_1152 | 125 |
| Clostridium_XIVa | Ascusb_1166 | 126 |
| Acinetobacter | Ascusb_1170 | 127 |
| Bacteroides | Ascusb_1176 | 128 |
| Erysipelothrix | Ascusb_1182 | 129 |
| Coprococcus | Ascusb_1199 | 130 |
| Clostridium_XIVa | Ascusb_1201 | 131 |
| Bacteroides | Ascusb_1218 | 132 |
| Coprococcus | Ascusb_1239 | 133 |
| Anaerovorax | Ascusb_1269 | 134 |
| Pseudoflavonifractor | Ascusb_1296 | 135 |
| Pseudoflavonifractor | Ascusb_1296 | 136 |
| Prevotella | Ascusb_1298 | 137 |
| Lachnospiracea_incertae_sedis | Ascusb_1304 | 138 |
| Roseburia | Ascusb_1320 | 139 |
| Prevotella | Ascusb_1330 | 140 |
| Ruminococcus | Ascusb_1336 | 141 |
| Atopobium | Ascusb_1341 | 142 |
| Eubacterium | Ascusb_1347 | 143 |
| Robinsoniella | Ascusb_1355 | 144 |
| Neisseria | Ascusb_1357 | 145 |
| Ruminococcus | Ascusb_1362 | 146 |
| Prevotella | Ascusb_1364 | 147 |
| Slackia | Ascusb_1389 | 148 |
| Prevotella | Ascusb_1400 | 149 |
| Clostridium_XIVa | Ascusb_1410 | 150 |
| Bacteroides | Ascusb_1417 | 151 |
| Anaerorhabdus | Ascusb_1426 | 152 |
| Bacteroides | Ascusb_1433 | 153 |
| Prevotella | Ascusb_1439 | 154 |
| Corynebacterium | Ascusb_1440 | 155 |
| Atopobium | Ascusb_1468 | 156 |
| Streptophyta | Ascusb_1473 | 157 |
| Prevotella | Ascusb_1485 | 158 |
| Roseburia | Ascusb_1490 | 159 |
| Prevotella | Ascusb_1492 | 160 |
| Prevotella | Ascusb_1528 | 161 |
| Eubacterium | Ascusb_1538 | 162 |
| Rhodocista | Ascusb_1543 | 163 |
| Prevotella | Ascusb_1546 | 164 |
| Clostridium_XIVa | Ascusb_1553 | 165 |
| Prevotella | Ascusb_1554 | 166 |
| Prevotella | Ascusb_1571 | 167 |
| Streptophyta | Ascusb_1578 | 168 |
| Ochrobactrum | Ascusb_1580 | 169 |
| Mogibacterium | Ascusb_1591 | 170 |
| Adlercreutzia | Ascusb_1600 | 171 |
| Prevotella | Ascusb_1609 | 172 |
| Riemerella | Ascusb_1627 | 173 |
| Prevotella | Ascusb_1640 | 174 |
| Roseburia | Ascusb_1645 | 175 |

TABLE 3-continued

Bacteria of the present disclosure.

| Predicted Closest Taxa of Isolated Microbes | Strain Designation | Sequence Identifier |
|---|---|---|
| Slackia | Ascusb_1647 | 176 |
| Clostridium_IV | Ascusb_1656 | 177 |
| Syntrophococcus | Ascusb_1659 | 178 |
| Prevotella | Ascusb_1667 | 179 |
| Treponema | Ascusb_1689 | 180 |
| Prevotella | Ascusb_1708 | 181 |
| Anaerovorax | Ascusb_1723 | 182 |
| Prevotella | Ascusb_1727 | 183 |
| Methanobrevibacter | Ascusb_1739 | 184 |
| Corynebacterium | Ascusb_1773 | 185 |
| Clostridium_XIVa | Ascusb_1793 | 186 |
| Alkaliphilus | Ascusb_1795 | 187 |
| Ruminococcus | Ascusb_1797 | 188 |
| Clostridium_XIVa | Ascusb_1806 | 189 |
| Eubacterium | Ascusb_1819 | 190 |
| Bacteroides | Ascusb_1835 | 191 |
| Roseburia | Ascusb_1886 | 192 |
| Lentisphaera | Ascusb_1901 | 193 |
| Eubacterium | Ascusb_1905 | 194 |
| Roseburia | Ascusb_1918 | 195 |
| Clostridium_IV | Ascusb_1922 | 196 |
| Hahella | Ascusb_1947 | 197 |
| Butyricicoccus | Ascusb_1969 | 198 |
| Clostridium_IV | Ascusb_2016 | 199 |
| Prevotella | Ascusb_2024 | 200 |
| Clostridium_IV | Ascusb_2058 | 201 |
| Desulfovibrio | Ascusb_2081 | 202 |
| Sphingobacterium | Ascusb_2101 | 203 |
| Roseburia | Ascusb_2105 | 204 |
| Bacteroides | Ascusb_2131 | 205 |
| Ruminococcus | Ascusb_2141 | 206 |
| Prevotella | Ascusb_2156 | 207 |
| Asteroleplasma | Ascusb_2168 | 208 |
| Syntrophococcus | Ascusb_2182 | 209 |
| Victivallis | Ascusb_2199 | 210 |
| Lachnobacterium | Ascusb_2210 | 211 |
| Lachnospiracea_incertae_sedis | Ascusb_2211 | 212 |
| Clostridium_IV | Ascusb_2218 | 213 |
| Anaerorhabdus | Ascusb_2221 | 214 |
| Altererythrobacter | Ascusb_2236 | 215 |
| Clostridium_XIVa | Ascusb_2246 | 216 |
| Clostridium_XIVa | Ascusb_2263 | 217 |
| Proteiniclasticum | Ascusb_2264 | 218 |
| Bifidobacterium | Ascusb_2308 | 219 |
| Clostridium_XIVa | Ascusb_2322 | 220 |
| Clostridium_XIVa | Ascusb_2323 | 221 |
| Desulfovibrio | Ascusb_2332 | 222 |
| Clostridium_XIVa | Ascusb_2353 | 223 |
| Nitrobacter | Ascusb_2375 | 224 |
| Enterorhabdus | Ascusb_2414 | 225 |
| Clostridium_sensu_stricto | Ascusb_2429 | 226 |
| Oscillibacter | Ascusb_2435 | 227 |
| Nautilia | Ascusb_2437 | 228 |
| Corynebacterium | Ascusb_2447 | 229 |
| Ruminococcus | Ascusb_2452 | 230 |
| Coprococcus | Ascusb_2461 | 231 |
| Eubacterium | Ascusb_2462 | 232 |
| Rikenella | Ascusb_2470 | 233 |
| Clostridium_XIVa | Ascusb_2482 | 234 |
| Paenibacillus | Ascusb_2487 | 235 |
| Ruminococcus | Ascusb_2492 | 236 |
| Prevotella | Ascusb_2503 | 237 |
| Haematobacter | Ascusb_2504 | 238 |
| Prevotella | Ascusb_2523 | 239 |
| Clostridium_XIVa | Ascusb_2537 | 240 |
| Lachnospiracea_incertae_sedis | Ascusb_2538 | 241 |
| Enterorhabdus | Ascusb_2565 | 242 |
| Blautia | Ascusb_2591 | 243 |
| Sporobacter | Ascusb_2592 | 244 |
| Oscillibacter | Ascusb_2607 | 245 |
| Clostridium_XIVa | Ascusb_2608 | 246 |
| Atopobium | Ascusb_2613 | 247 |
| Sporobacter | Ascusb_2626 | 248 |
| Clostridium_XIVa | Ascusb_2629 | 249 |
| Candidate Phylum OD1 | Ascusb_2643 | 250 |
| Oscillibacter | Ascusb_2645 | 251 |
| Clostridium_XIVa | Ascusb_2647 | 252 |
| Clostridium_IV | Ascusb_2649 | 253 |
| Mogibacterium | Ascusb_2653 | 254 |
| Roseburia | Ascusb_2663 | 255 |
| Lachnospiracea_incertae_sedis | Ascusb_2671 | 256 |
| Pelotomaculum | Ascusb_2696 | 257 |
| Pelotomaculum | Ascusb_2712 | 258 |
| Clostridium_XIVa | Ascusb_2713 | 259 |
| Robinsoniella | Ascusb_2730 | 260 |
| Coprococcus | Ascusb_2746 | 261 |
| Wautersiella | Ascusb_2757 | 262 |
| Lachnospiracea_incertae_sedis | Ascusb_2762 | 263 |
| Planctomyces | Ascusb_2764 | 264 |
| Treponema | Ascusb_2800 | 265 |
| Coprococcus | Ascusb_2806 | 266 |
| Paracoccus | Ascusb_2809 | 267 |
| Ruminococcus | Ascusb_2811 | 268 |
| Atopobium | Ascusb_2814 | 269 |
| Prevotella | Ascusb_2825 | 270 |
| Clostridium_IV | Ascusb_2832 | 271 |
| Clostridium_XIVa | Ascusb_2838 | 272 |
| Clostridium_XIVa | Ascusb_2843 | 273 |
| Clostridium_XIVa | Ascusb_2853 | 274 |
| Prevotella | Ascusb_2857 | 275 |
| Dethiosulfovibrio | Ascusb_2872 | 276 |
| Clostridium_XI | Ascusb_2885 | 277 |
| Clostridium_IV | Ascusb_2907 | 278 |
| Saccharofermentans | Ascusb_2909 | 279 |
| Clostridium_sensu_stricto | Ascusb_2912 | 280 |
| Roseburia | Ascusb_2914 | 281 |
| Lachnospiracea_incertae_sedis | Ascusb_2930 | 282 |
| Candidate phylum SR1 | Ascusb_2946 | 283 |
| Hydrogenoanaerobacterium | Ascusb_2948 | 284 |
| Victivallis | Ascusb_2966 | 285 |
| Clostridium_IV | Ascusb_2983 | 286 |
| Pelotomaculum | Ascusb_2988 | 287 |
| Clostridium_XIVa | Ascusb_2990 | 288 |
| Saccharofermentans | Ascusb_3005 | 289 |
| Lachnospiracea_incertae_sedis | Ascusb_3008 | 290 |
| Coprococcus | Ascusb_3010 | 291 |
| Clostridium_XIVa | Ascusb_3022 | 292 |
| Clostridium_XIVb | Ascusb_3029 | 293 |
| Papillibacter | Ascusb_3053 | 294 |
| Bartonella | Ascusb_3056 | 295 |
| Clostridium_IV | Ascusb_3058 | 296 |
| Eubacterium | Ascusb_3061 | 297 |
| Asaccharobacter | Ascusb_3066 | 298 |
| Clostridium_IV | Ascusb_3073 | 299 |
| Blautia | Ascusb_3074 | 300 |
| Prevotella | Ascusb_3079 | 301 |
| Ruminococcus | Ascusb_3087 | 302 |
| Selenomonas | Ascusb_3120 | 303 |
| Treponema | Ascusb_3142 | 304 |
| Adlercreutzia | Ascusb_3147 | 305 |
| Butyricicoccus | Ascusb_3161 | 306 |
| Pseudoflavonifractor | Ascusb_3163 | 307 |
| Corynebacterium | Ascusb_3165 | 308 |
| Adlercreutzia | Ascusb_3188 | 309 |
| Selenomonas | Ascusb_3197 | 310 |
| Coraliomargarita | Ascusb_3213 | 311 |
| Paraprevotella | Ascusb_3225 | 312 |
| Oscillibacter | Ascusb_3229 | 313 |
| Anaerovorax | Ascusb_3240 | 314 |
| Clostridium_XIVa | Ascusb_3242 | 315 |
| Saccharofermentans | Ascusb_3248 | 316 |
| Erysipelothrix | Ascusb_3263 | 317 |
| Agaricicola | Ascusb_3275 | 318 |
| Denitrobacterium | Ascusb_3285 | 319 |
| Armatimonadetes | Ascusb_3299 | 320 |
| Asaccharobacter | Ascusb_3304 | 321 |
| Anaeroplasma | Ascusb_3322 | 322 |
| Prevotella | Ascusb_3333 | 323 |

TABLE 3-continued

Bacteria of the present disclosure.

| Predicted Closest Taxa of Isolated Microbes | Strain Designation | Sequence Identifier |
|---|---|---|
| Lachnospiracea_incertae_sedis | Ascusb_3339 | 324 |
| Clostridium_IV | Ascusb_3351 | 325 |
| Streptococcus | Ascusb_3376 | 326 |
| Cellulosilyticum | Ascusb_3393 | 327 |
| Asaccharobacter | Ascusb_3405 | 328 |
| Enterorhabdus | Ascusb_3408 | 329 |
| Treponema | Ascusb_3415 | 330 |
| Roseburia | Ascusb_3417 | 331 |
| Victivallis | Ascusb_3422 | 332 |
| Prevotella | Ascusb_3424 | 333 |
| Roseburia | Ascusb_3446 | 334 |
| Ruminococcus | Ascusb_3451 | 335 |
| Mogibacterium | Ascusb_3456 | 336 |
| Lachnospiracea_incertae_sedis | Ascusb_3467 | 337 |
| Prevotella | Ascusb_3479 | 338 |
| Clostridium_sensu_stricto | Ascusb_3480 | 339 |
| Victivallis | Ascusb_3481 | 340 |
| Cyanobacteria | Ascusb_3482 | 341 |
| Treponema | Ascusb_3483 | 342 |
| Stenotrophomonas | Ascusb_3484 | 343 |
|  | Ascusb_3492 | 344 |
| Clostridium_XIVa | Ascusb_3494 | 345 |
| Sphingobium | Ascusb_3495 | 346 |
| Lachnospiracea_incertae_sedis | Ascusb_3512 | 347 |
| Oscillibacter | Ascusb_3518 | 348 |
| Methylobacterium | Ascusb_3523 | 349 |
| Zhangella | Ascusb_3530 | 350 |
| Lachnospiracea_incertae_sedis | Ascusb_3545 | 351 |
| Oscillibacter | Ascusb_3546 | 352 |
| Clostridium_III | Ascusb_3548 | 353 |
| Coraliomargarita | Ascusb_3563 | 354 |
| Eubacterium | Ascusb_3575 | 355 |
| Enterorhabdus | Ascusb_3578 | 356 |
| Clostridium_XIVa | Ascusb_3587 | 357 |
| Saccharofermentans | Ascusb_3592 | 358 |
| Clostridium_IV | Ascusb_3600 | 359 |
| Clostridium_sensu_stricto | Ascusb_3602 | 360 |
| Victivallis | Ascusb_3638 | 361 |
| Coprococcus | Ascusb_3642 | 362 |
| Pseudoflavonifractor | Ascusb_3647 | 363 |
| Anaeroplasma | Ascusb_3674 | 364 |
| Anaeroplasma | Ascusb_3687 | 365 |
| Bacteroides | Ascusb_3700 | 366 |
| Acinetobacter | Ascusb_3717 | 367 |
| Victivallis | Ascusb_3724 | 368 |
| Victivallis | Ascusb_3725 | 369 |
| Mogibacterium | Ascusb_3728 | 370 |
| Oscillibacter | Ascusb_3746 | 371 |
| Butyricimonas | Ascusb_3748 | 372 |
| Dethiosulfovibrio | Ascusb_3750 | 373 |
| Pseudoflavonifractor | Ascusb_3751 | 374 |
| Clostridium_IV | Ascusb_3762 | 375 |
| Anaeroplasma | Ascusb_3763 | 376 |
| Oscillibacter | Ascusb_3768 | 377 |
| Herbiconiux | Ascusb_3775 | 378 |
| Eubacterium | Ascusb_3779 | 379 |
| Armatimonadetes | Ascusb_3789 | 380 |
| Selenomonas | Ascusb_3796 | 381 |
| Clostridium_IV | Ascusb_3811 | 382 |
| Mogibacterium | Ascusb_3825 | 383 |
| Clostridium_IV | Ascusb_3838 | 384 |
| Roseburia | Ascusb_3849 | 385 |
| Anaerovibrio | Ascusb_3866 | 386 |
| Clostridium_III | Ascusb_3875 | 387 |
| Saccharofermentans | Ascusb_3903 | 388 |
| Saccharofermentans | Ascusb_3911 | 389 |
| Prevotella | Ascusb_3914 | 390 |
| Clostridium_XIVa | Ascusb_3919 | 391 |
| Robinsoniella | Ascusb_3950 | 392 |
| Brevundimonas | Ascusb_3952 | 393 |
| Anaerotruncus | Ascusb_3970 | 394 |
| Victivallis | Ascusb_3982 | 395 |
| Bacteroides | Ascusb_4008 | 396 |
| Clostridium_XIVb | Ascusb_4019 | 397 |
| Prevotella | Ascusb_4033 | 398 |
| Ruminococcus | Ascusb_4034 | 399 |
| Pelobacter | Ascusb_4040 | 400 |
| Clostridium_XIVa | Ascusb_4063 | 401 |
| Clostridium_XIVa | Ascusb_4067 | 402 |
| Clostridium_XIVb | Ascusb_4083 | 403 |
| Coprococcus | Ascusb_4085 | 404 |
| Clostridium_IV | Ascusb_4086 | 405 |
| Clostridium_IV | Ascusb_4095 | 406 |
| Coprococcus | Ascusb_4114 | 407 |
| Victivallis | Ascusb_4115 | 408 |
| Clostridium_III | Ascusb_4118 | 409 |
| Anaerovibrio | Ascusb_4120 | 410 |
| Anaerovorax | Ascusb_4124 | 411 |
| Proteiniclasticum | Ascusb_4142 | 412 |
| Anaerovorax | Ascusb_4143 | 413 |
| Selenomonas | Ascusb_4149 | 414 |
| Hydrogenoanaerobacterium | Ascusb_4155 | 415 |
| Acetanaerobacterium | Ascusb_4156 | 416 |
| Clostridium_XIVa | Ascusb_4159 | 417 |
| Asaccharobacter | Ascusb_4161 | 418 |
| Clostridium_XIVa | Ascusb_4167 | 419 |
| Lachnospiracea_incertae_sedis | Ascusb_4171 | 420 |
| Saccharofermentans | Ascusb_4172 | 421 |
| Prevotella | Ascusb_4176 | 422 |
| Anaeroplasma | Ascusb_4179 | 423 |
| Spirochaeta | Ascusb_4188 | 424 |
| Alkaliphilus | Ascusb_4213 | 425 |
| Paraprevotella | Ascusb_4215 | 426 |
| Hippea | Ascusb_4217 | 427 |
| Prevotella | Ascusb_4223 | 428 |
| Prevotella | Ascusb_4237 | 429 |
| Hydrogenoanaerobacterium | Ascusb_4241 | 430 |
| Clostridium_sensu_stricto | Ascusb_4265 | 431 |
| Paraeggerthella | Ascusb_4266 | 432 |
| Clostridium_XIVa | Ascusb_4277 | 433 |
| Clostridium_XIVa | Ascusb_4279 | 434 |
| Clostridium_IV | Ascusb_4281 | 435 |
| Clostridium_XIVa | Ascusb_4292 | 436 |
| Adhaeribacter | Ascusb_4313 | 437 |
| Syntrophococcus | Ascusb_4316 | 438 |
| Clostridium_sensu_stricto | Ascusb_4317 | 439 |
| Saccharofermentans | Ascusb_4326 | 440 |
| Clostridium_IV | Ascusb_4332 | 441 |
| Clostridium_IV | Ascusb_4345 | 442 |
| Clostridium_sensu_stricto | Ascusb_4347 | 443 |
| Coraliomargarita | Ascusb_4375 | 444 |
| Sharpea | Ascusb_4380 | 445 |
| Clostridium_IV | Ascusb_4394 | 446 |
| Anaerovorax | Ascusb_4416 | 447 |
| Blautia | Ascusb_4421 | 448 |
| Clostridium_XIVa | Ascusb_4422 | 449 |
| Clostridium_IV | Ascusb_4432 | 450 |
| Anaerovorax | Ascusb_4433 | 451 |
| Coraliomargarita | Ascusb_4434 | 452 |
| Lachnospiracea_incertae_sedis | Ascusb_4442 | 453 |
| Aquiflexum | Ascusb_4449 | 454 |
| Pedobacter | Ascusb_4450 | 455 |
| Robinsoniella | Ascusb_4457 | 456 |
| Pelomonas | Ascusb_4468 | 457 |
| Saccharofermentans | Ascusb_4469 | 458 |
| Paracoccus | Ascusb_4479 | 459 |
| Enterorhabdus | Ascusb_4486 | 460 |
| Beijerinckia | Ascusb_4496 | 461 |
| Sporobacter | Ascusb_4505 | 462 |
| Clostridium_IV | Ascusb_4517 | 463 |
| Bacillus | Ascusb_4522 | 464 |
| Saccharofermentans | Ascusb_4537 | 465 |
| Spirochaeta | Ascusb_4545 | 466 |
| Prevotella | Ascusb_4548 | 467 |
| Eubacterium | Ascusb_4556 | 468 |
| Herbiconiux | Ascusb_4559 | 469 |
| Brevundimonas | Ascusb_4560 | 470 |
| Mogibacterium | Ascusb_4563 | 471 |

TABLE 3-continued

Bacteria of the present disclosure.

| Predicted Closest Taxa of Isolated Microbes | Strain Designation | Sequence Identifier |
|---|---|---|
| Anaerorhabdus | Ascusb_4566 | 472 |
| Victivallis | Ascusb_4569 | 473 |
| Prevotella | Ascusb_4573 | 474 |
| Anaerovorax | Ascusb_4579 | 475 |
| Aquiflexum | Ascusb_4606 | 476 |
| Oscillibacter | Ascusb_4618 | 477 |
| Altererythrobacter | Ascusb_4626 | 478 |
| Hydrogenoanaerobacterium | Ascusb_4627 | 479 |
| Clostridium_III | Ascusb_4634 | 480 |
| Clostridium_XIVb | Ascusb_4639 | 481 |
| Saccharofermentans | Ascusb_4644 | 482 |
| Roseburia | Ascusb_4652 | 483 |
| Anaeroplasma | Ascusb_4657 | 484 |
| Planctomyces | Ascusb_4676 | 485 |
| Ruminococcus | Ascusb_4679 | 486 |
| Selenomonas | Ascusb_4695 | 487 |
| Anaeroplasma | Ascusb_4696 | 488 |
| Anaerovorax | Ascusb_4700 | 489 |
| Rummeliibacillus | Ascusb_4701 | 490 |
| Clostridium_XIVa | Ascusb_4716 | 491 |
| Anaeroplasma | Ascusb_4731 | 492 |
| Butyrivibrio | Ascusb_4737 | 493 |
| Lachnospiracea_incertae_sedis | Ascusb_4738 | 494 |
| Anaerotruncus | Ascusb_4758 | 495 |
| Syntrophococcus | Ascusb_4763 | 496 |
| Paraeggerthella | Ascusb_4795 | 497 |
| Papillibacter | Ascusb_4800 | 498 |
| Lachnospiracea_incertae_sedis | Ascusb_4805 | 499 |
| Prevotella | Ascusb_4820 | 500 |
| Papillibacter | Ascusb_4828 | 501 |
| Streptococcus | Ascusb_4852 | 502 |
| Methanobrevibacter | Ascusb_4859 | 503 |
| Prevotella | Ascusb_4861 | 504 |
| Prevotella | Ascusb_4867 | 505 |
| Prevotella | Ascusb_4873 | 506 |
| Coraliomargarita | Ascusb_4882 | 507 |
| Prevotella | Ascusb_4886 | 508 |
| Thermotalea | Ascusb_4893 | 509 |
| Clostridium_XIVa | Ascusb_4897 | 510 |
| Atopobium | Ascusb_4945 | 511 |
| Prevotella | Ascusb_4969 | 512 |
| Mogibacterium | Ascusb_4972 | 513 |
| Clostridium_XIVa | Ascusb_4976 | 514 |
| Clostridium_XIVa | Ascusb_4997 | 515 |
| Eggerthella | Ascusb_4999 | 516 |
| Blautia | Ascusb_5000 | 517 |
| Vampirovibrio | Ascusb_5006 | 518 |
| Papillibacter | Ascusb_5040 | 519 |
| Beijerinckia | Ascusb_5058 | 520 |
| Bacteroides | Ascusb_5060 | 521 |
| Desulfotomaculum | Ascusb_5065 | 522 |
| Acidobacteria | Ascusb_5069 | 523 |
| Clostridium_XIVa | Ascusb_5081 | 524 |
| Clostridium_XIVa | Ascusb_5089 | 525 |
| Clostridium_XIVa | Ascusb_5095 | 526 |
| Cryptanaerobacter | Ascusb_5103 | 527 |
| Prevotella | Ascusb_5113 | 528 |
| Syntrophomonas | Ascusb_5137 | 529 |
| Erysipelothrix | Ascusb_5144 | 530 |
| Selenomonas | Ascusb_5165 | 531 |
| Clostridium_III | Ascusb_5171 | 532 |
| Flavobacterium | Ascusb_5181 | 533 |
| Thermotalea | Ascusb_5191 | 534 |
| Lachnospiracea_incertae_sedis | Ascusb_5194 | 535 |
| Mucilaginibacter | Ascusb_5197 | 536 |
| Bacteroides | Ascusb_5198 | 537 |
| Ruminococcus | Ascusb_5206 | 538 |
| Clostridium_XIVa | Ascusb_5223 | 539 |
| Asaccharobacter | Ascusb_5225 | 540 |
| Blautia | Ascusb_5235 | 541 |
| Mucilaginibacter | Ascusb_5247 | 542 |
| Coprococcus | Ascusb_5252 | 543 |
| Lachnospiracea_incertae_sedis | Ascusb_5253 | 544 |
| Butyricimonas | Ascusb_5255 | 545 |
| Lachnospiracea_incertae_sedis | Ascusb_5267 | 546 |
| Treponema | Ascusb_5280 | 547 |
| Clostridium_sensu_stricto | Ascusb_5281 | 548 |
| Clostridium_XIVa | Ascusb_5289 | 549 |
| Anaerovorax | Ascusb_5292 | 550 |
| Saccharofermentans | Ascusb_5294 | 551 |
| Clostridium_XIVa | Ascusb_5295 | 552 |
| Clostridium_III | Ascusb_5301 | 553 |
| Clostridium_IV | Ascusb_5313 | 554 |
| Ruminococcus | Ascusb_5324 | 555 |
| Clostridium_XIVa | Ascusb_5326 | 556 |
| Clostridium_XI | Ascusb_5335 | 557 |
| Clostridium_XIVa | Ascusb_5336 | 558 |
| Eubacterium | Ascusb_5338 | 559 |
| Lachnospiracea_incertae_sedis | Ascusb_5342 | 560 |
| Clostridium_IV | Ascusb_5352 | 561 |
| Ruminococcus | Ascusb_5353 | 562 |
| Clostridium_IV | Ascusb_5354 | 563 |
| Faecalibacterium | Ascusb_5360 | 564 |
| Anaerovibrio | Ascusb_5368 | 565 |
| Asaccharobacter | Ascusb_5397 | 566 |
| Pelotomaculum | Ascusb_5411 | 567 |
| Spirochaeta | Ascusb_5422 | 568 |
| Prevotella | Ascusb_5429 | 569 |
| Lachnospiracea_incertae_sedis | Ascusb_5440 | 570 |
| Anaerovorax | Ascusb_5441 | 571 |
| Clostridium_IV | Ascusb_5443 | 572 |
| Victivallis | Ascusb_5451 | 573 |
| Syntrophococcus | Ascusb_5456 | 574 |
| Syntrophococcus | Ascusb_5463 | 575 |
| Desulfovibrio | Ascusb_5481 | 576 |
| Lachnospiracea_incertae_sedis | Ascusb_5485 | 577 |
| Lachnospiracea_incertae_sedis | Ascusb_5495 | 578 |
| Clostridium_IV | Ascusb_5509 | 579 |
| Prevotella | Ascusb_5510 | 580 |
| Victivallis | Ascusb_5512 | 581 |
| Clostridium_XIVa | Ascusb_5515 | 582 |
| Selenomonas | Ascusb_5517 | 583 |
| Bacteroides | Ascusb_5530 | 584 |
| Clostridium_XIVa | Ascusb_5536 | 585 |
| Eggerthella | Ascusb_5554 | 586 |
| Selenomonas | Ascusb_5584 | 587 |
| Mogibacterium | Ascusb_5592 | 588 |
| Armatimonadetes | Ascusb_5609 | 589 |
| Clostridium_XIVa | Ascusb_5612 | 590 |
| Victivallis | Ascusb_5623 | 591 |
| Paraprevotella | Ascusb_5628 | 592 |
| Brevundimonas | Ascusb_5647 | 593 |
| Prevotella | Ascusb_5650 | 594 |
| Prevotella | Ascusb_5652 | 595 |
| Robinsoniella | Ascusb_5660 | 596 |
| Clostridium_III | Ascusb_5686 | 597 |
| Butyricimonas | Ascusb_5689 | 598 |
| Spirochaeta | Ascusb_5691 | 599 |
| Hydrogenoanaerobacterium | Ascusb_5694 | 600 |
| Proteiniclasticum | Ascusb_5716 | 601 |
| Roseburia | Ascusb_5725 | 602 |
| Clostridium_XIVa | Ascusb_5738 | 603 |
| Anaerofustis | Ascusb_5746 | 604 |
| Succiniclasticum | Ascusb_5765 | 605 |
| Anaeroplasma | Ascusb_5770 | 606 |
| Oscillibacter | Ascusb_5777 | 607 |
| Escherichia/Shigella | Ascusb_5789 | 608 |
| Bacteroides | Ascusb_5812 | 609 |
| Clostridium_XIVa | Ascusb_5830 | 610 |
| Clostridium_XIVa | Ascusb_5838 | 611 |
| Clostridium_IV | Ascusb_5841 | 612 |
| Clostridium_III | Ascusb_5845 | 613 |
| Prevotella | Ascusb_5847 | 614 |
| Coprococcus | Ascusb_5849 | 615 |
| Oscillibacter | Ascusb_5858 | 616 |
| Parabacteroides | Ascusb_5862 | 617 |
| Bacteroides | Ascusb_5868 | 618 |
| Mogibacterium | Ascusb_5869 | 619 |

TABLE 3-continued

Bacteria of the present disclosure.

| Predicted Closest Taxa of Isolated Microbes | Strain Designation | Sequence Identifier |
|---|---|---|
| Solobacterium | Ascusb_5870 | 620 |
| Bacteroides | Ascusb_5874 | 621 |
| Clostridium_III | Ascusb_5877 | 622 |
| Victivallis | Ascusb_5879 | 623 |
| Saccharofermentans | Ascusb_5884 | 624 |
| Saccharofermentans | Ascusb_5889 | 625 |
| Olivibacter | Ascusb_5894 | 626 |
| Thermotalea | Ascusb_5895 | 627 |
| Proteiniclasticum | Ascusb_5913 | 628 |
| Clostridium_III | Ascusb_5926 | 629 |
| Anaeroplasma | Ascusb_5934 | 630 |
| Treponema | Ascusb_5939 | 631 |
| Clostridium_XIVa | Ascusb_5940 | 632 |
| Clostridium_III | Ascusb_5950 | 633 |
| Desulfotomaculum | Ascusb_5953 | 634 |
| Bacillus | Ascusb_5969 | 635 |
| Anaerovorax | Ascusb_5972 | 636 |
| Ruminococcus | Ascusb_5973 | 637 |
| Agarivorans | Ascusb_5975 | 638 |
| Anaerotruncus | Ascusb_5979 | 639 |
| Papillibacter | Ascusb_5984 | 640 |
| Clostridium_XIVa | Ascusb_5991 | 641 |
| Clostridium_III | Ascusb_5996 | 642 |
| Bacteroides | Ascusb_5997 | 643 |
| Clostridium_XIVa | Ascusb_5998 | 644 |
| Ruminococcus | Ascusb_6003 | 645 |
| Clostridium_XIVa | Ascusb_6005 | 646 |
| Oscillibacter | Ascusb_6006 | 647 |
| Nitrobacter | Ascusb_6022 | 648 |
| Clostridium_XIVa | Ascusb_6026 | 649 |
| Lachnospiracea_incertae_sedis | Ascusb_6035 | 650 |
| Limibacter | Ascusb_6037 | 651 |
| Desulfovibrio | Ascusb_6053 | 652 |
| Coprococcus | Ascusb_6067 | 653 |
| Anaerovorax | Ascusb_6070 | 654 |
| Spirochaeta | Ascusb_6074 | 655 |
| Cyanobacteria | Ascusb_6079 | 656 |
| Saccharofermentans | Ascusb_6081 | 657 |
| Anaeroplasma | Ascusb_6106 | 658 |
| Clostridium_III | Ascusb_6115 | 659 |
| Victivallis | Ascusb_6151 | 660 |
| Enterorhabdus | Ascusb_6168 | 661 |
| Clostridium_IV | Ascusb_6169 | 662 |
| Erysipelothrix | Ascusb_6172 | 663 |
| Clostridium_III | Ascusb_6200 | 664 |
| Clostridium_sensu_stricto | Ascusb_6207 | 665 |
| Gelidibacter | Ascusb_6212 | 666 |
| Roseburia | Ascusb_6219 | 667 |
| Neisseria | Ascusb_6270 | 668 |
| Prevotella | Ascusb_6273 | 669 |
| Cyanobacteria | Ascusb_6275 | 670 |
| Oscillibacter | Ascusb_6282 | 671 |
| Candidate phylum TM7 | Ascusb_6313 | 672 |
| Prevotella | Ascusb_6326 | 673 |
| Saccharofermentans | Ascusb_6330 | 674 |
| Erysipelotrichaceae_incertae_sedis | Ascusb_6337 | 675 |
| Spirochaeta | Ascusb_6342 | 676 |
| Clostridium_XIVa | Ascusb_6372 | 677 |
| Clostridium_XIVb | Ascusb_6376 | 678 |
| Clostridium_XIVa | Ascusb_6387 | 679 |
| Adlercreutzia | Ascusb_6389 | 680 |
| Clostridium_XIVa | Ascusb_6394 | 681 |
| Lachnospiracea_incertae_sedis | Ascusb_6400 | 682 |
| Clostridium_IV | Ascusb_6403 | 683 |
| Adlercreutzia | Ascusb_6406 | 684 |
| Prevotella | Ascusb_6409 | 685 |
| Syntrophococcus | Ascusb_6420 | 686 |
| Treponema | Ascusb_6433 | 687 |
| Prevotella | Ascusb_6448 | 688 |
| Clostridium_III | Ascusb_6450 | 689 |
| Pseudoflavonifractor | Ascusb_6463 | 690 |
| Clostridium_IV | Ascusb_6468 | 691 |
| Sharpea | Ascusb_6473 | 692 |
| Dongia | Ascusb_6499 | 693 |
| Eubacterium | Ascusb_6505 | 694 |
| Prevotella | Ascusb_6507 | 695 |
| Clostridium_IV | Ascusb_6519 | 696 |
| Parabacteroides | Ascusb_6525 | 697 |
| Brevundimonas | Ascusb_6535 | 698 |
| Clostridium_XIVa | Ascusb_6540 | 699 |
| Ruminococcus | Ascusb_6541 | 700 |
| Thermotalea | Ascusb_6558 | 701 |
| Victivallis | Ascusb_6561 | 702 |
| Anaeroplasma | Ascusb_6563 | 703 |
| Oscillibacter | Ascusb_6564 | 704 |
| Ruminococcus | Ascusb_6570 | 705 |
| Clostridium_XIVa | Ascusb_6578 | 706 |
| Clostridium_XIVa | Ascusb_6581 | 707 |
| Clostridium_IV | Ascusb_6586 | 708 |
| Roseburia | Ascusb_6593 | 709 |
| Eggerthella | Ascusb_6612 | 710 |
| Clostridium_III | Ascusb_6614 | 711 |
| Clostridium_XIVa | Ascusb_6621 | 712 |
| Lactobacillus | Ascusb_6630 | 713 |
| Bacteroides | Ascusb_6633 | 714 |
| Cellulosilyticum | Ascusb_6635 | 715 |
| Brevundimonas | Ascusb_6645 | 716 |
| Clostridium_IV | Ascusb_6670 | 717 |
| Prevotella | Ascusb_6672 | 718 |
| Helicobacter | Ascusb_6676 | 719 |
| Clostridium_IV | Ascusb_6683 | 720 |
| Proteiniclasticum | Ascusb_6684 | 721 |
| Brevundimonas | Ascusb_6701 | 722 |
| Clostridium_XIVa | Ascusb_6704 | 723 |
| Prevotella | Ascusb_6706 | 724 |
| Desulfovibrio | Ascusb_6708 | 725 |
| Coraliomargarita | Ascusb_6709 | 726 |
| Eubacterium | Ascusb_6715 | 727 |
| Sphingomonas | Ascusb_6718 | 728 |
| Prevotella | Ascusb_6730 | 729 |
| Clostridium_IV | Ascusb_6734 | 730 |
| Paraprevotella | Ascusb_6735 | 731 |
| Ruminococcus | Ascusb_6746 | 732 |
| Saccharofermentans | Ascusb_6756 | 733 |
| Clostridium_III | Ascusb_6757 | 734 |
| Clostridium_III | Ascusb_6774 | 735 |
| Turicibacter | Ascusb_6792 | 736 |
| Prevotella | Ascusb_6796 | 737 |
| Clostridium_XIVa | Ascusb_6803 | 738 |
| Fusibacter | Ascusb_6813 | 739 |
| Clostridium_XIVa | Ascusb_6824 | 740 |
| Clostridium_IV | Ascusb_6833 | 741 |
| Rummeliibacillus | Ascusb_6848 | 742 |
| Mogibacterium | Ascusb_6852 | 743 |
| Bacteroides | Ascusb_6864 | 744 |
| Pelospora | Ascusb_6875 | 745 |
| Eggerthella | Ascusb_6880 | 746 |
| Eubacterium | Ascusb_6887 | 747 |
| Blautia | Ascusb_6889 | 748 |
| Clostridium_XIVb | Ascusb_6901 | 749 |
| Ehrlichia | Ascusb_6907 | 750 |
| Eubacterium | Ascusb_6930 | 751 |
| Prevotella | Ascusb_6943 | 752 |
| Clostridium_XIVa | Ascusb_6952 | 753 |
| Treponema | Ascusb_6954 | 754 |
| Hydrogenoanaerobacterium | Ascusb_6957 | 755 |
| Selenomonas | Ascusb_6964 | 756 |
| Saccharofermentans | Ascusb_6966 | 757 |
| Clostridium_IV | Ascusb_6971 | 758 |
| Clostridium_sensu_stricto | Ascusb_6976 | 759 |
| Anaerovorax | Ascusb_6979 | 760 |
| Spirochaeta | Ascusb_6997 | 761 |
| Brevundimonas | Ascusb_7001 | 762 |
| Eubacterium | Ascusb_7017 | 763 |
| Clostridium_XIVa | Ascusb_7025 | 764 |
| Anaerovorax | Ascusb_7031 | 765 |
| Ruminococcus | Ascusb_7039 | 766 |
| Papillibacter | Ascusb_7040 | 767 |

TABLE 3-continued

Bacteria of the present disclosure.

| Predicted Closest Taxa of Isolated Microbes | Strain Designation | Sequence Identifier |
|---|---|---|
| Clostridium_IV | Ascusb_7043 | 768 |
| Hydrogenoanaerobacterium | Ascusb_7046 | 769 |
| Asaccharobacter | Ascusb_7048 | 770 |
| Clostridium_XIVa | Ascusb_7054 | 771 |
| Rhodocista | Ascusb_7078 | 772 |
| Clostridium_XIVa | Ascusb_7087 | 773 |
| Beijerinckia | Ascusb_7091 | 774 |
| Lactobacillus | Ascusb_7101 | 775 |
| Cryptanaerobacter | Ascusb_7102 | 776 |
| Prevotella | Ascusb_7113 | 777 |
| Anaerovibrio | Ascusb_7114 | 778 |
| Anaerovorax | Ascusb_7123 | 779 |
| Lachnospiracea_incertae_sedis | Ascusb_7128 | 780 |
| Enterorhabdus | Ascusb_7131 | 781 |
| Clostridium_XIVb | Ascusb_7141 | 782 |
| Selenomonas | Ascusb_7148 | 783 |
| Eubacterium | Ascusb_7149 | 784 |
| Thermotalea | Ascusb_7151 | 785 |
| Enterorhabdus | Ascusb_7153 | 786 |
| Clostridium_III | Ascusb_7159 | 787 |
| Acetanaerobacterium | Ascusb_7164 | 788 |
| Treponema | Ascusb_7168 | 789 |
| Clostridium_XIVa | Ascusb_7176 | 790 |
| Enterorhabdus | Ascusb_7180 | 791 |
| Prevotella | Ascusb_7188 | 792 |
| Desulfovibrio | Ascusb_7199 | 793 |
| Aminobacter | Ascusb_7213 | 794 |
| Clostridium_IV | Ascusb_7224 | 795 |
| Rikenella | Ascusb_7225 | 796 |
| Gordonibacter | Ascusb_7240 | 797 |
| Papillibacter | Ascusb_7245 | 798 |
| Syntrophococcus | Ascusb_7246 | 799 |
| Clostridium_sensu_stricto | Ascusb_7256 | 800 |
| Hahella | Ascusb_7257 | 801 |
| Vampirovibrio | Ascusb_7264 | 802 |
| Coprococcus | Ascusb_7275 | 803 |
| Coraliomargarita | Ascusb_7299 | 804 |
| Clostridium_III | Ascusb_7300 | 805 |
| Clostridium_XIVa | Ascusb_7304 | 806 |
| Desulfotomaculum | Ascusb_7325 | 807 |
| Helicobacter | Ascusb_7373 | 808 |
| Syntrophococcus | Ascusb_7380 | 809 |
| Lachnospiracea_incertae_sedis | Ascusb_7384 | 810 |
| Clostridium_IV | Ascusb_7385 | 811 |
| Paludibacter | Ascusb_7395 | 812 |
| Lachnospiracea_incertae_sedis | Ascusb_7401 | 813 |
| Lachnospiracea_incertae_sedis | Ascusb_7412 | 814 |
| Adhaeribacter | Ascusb_7419 | 815 |
| Clostridium_IV | Ascusb_7420 | 816 |
| Cryptanaerobacter | Ascusb_7424 | 817 |
| Idiomarina | Ascusb_7435 | 818 |
| Clostridium_IV | Ascusb_7437 | 819 |
| Selenomonas | Ascusb_7440 | 820 |
| Acetanaerobacterium | Ascusb_7444 | 821 |
| Bifidobacterium | Ascusb_7446 | 822 |
| Clostridium_XIVb | Ascusb_7449 | 823 |
| Asaccharobacter | Ascusb_7450 | 824 |
| Eubacterium | Ascusb_7452 | 825 |
| Anaeroplasma | Ascusb_7455 | 826 |
| Saccharofermentans | Ascusb_7456 | 827 |
| Ruminococcus | Ascusb_7467 | 828 |
| Clostridium_III | Ascusb_7470 | 829 |
| Acholeplasma | Ascusb_7472 | 830 |
| Pedobacter | Ascusb_7476 | 831 |
| Sphingomonas | Ascusb_7487 | 832 |
| Verrucomicrobia | Ascusb_7525 | 833 |
| Anaerovorax | Ascusb_7533 | 834 |
| Spirochaeta | Ascusb_7534 | 835 |
| Paraeggerthella | Ascusb_7539 | 836 |
| Lachnospiracea_incertae_sedis | Ascusb_7542 | 837 |
| Bacteroides | Ascusb_7543 | 838 |
| Paenibacillus | Ascusb_7549 | 839 |
| Prevotella | Ascusb_7553 | 840 |
| Bacteroides | Ascusb_7555 | 841 |
| Clostridium_XIVa | Ascusb_7563 | 842 |
| Clostridium_XIVa | Ascusb_7568 | 843 |
| Roseburia | Ascusb_7572 | 844 |
| Clostridium_XIVa | Ascusb_7581 | 845 |
| Clostridium_III | Ascusb_7591 | 846 |
| Pedobacter | Ascusb_7599 | 847 |
| Robinsoniella | Ascusb_7614 | 848 |
| Anaeroplasma | Ascusb_7615 | 849 |
| Clostridium_XIVa | Ascusb_7622 | 850 |
| Hydrogenoanaerobacterium | Ascusb_7626 | 851 |
| Turicibacter | Ascusb_7638 | 852 |
| Papillibacter | Ascusb_7645 | 853 |
| Clostridium_XIVa | Ascusb_7647 | 854 |
| Saccharofermentans | Ascusb_7648 | 855 |
| Clostridium_XIVb | Ascusb_7650 | 856 |
| Sporobacter | Ascusb_7662 | 857 |
| Asaccharobacter | Ascusb_7663 | 858 |
| Bacteroides | Ascusb_7669 | 859 |
| Anaeroplasma | Ascusb_7677 | 860 |
| Sporobacter | Ascusb_7680 | 861 |
| Streptomyces | Ascusb_7690 | 862 |
| Arcobacter | Ascusb_7694 | 863 |
| Clostridium_XIVa | Ascusb_7699 | 864 |
| Barnesiella | Ascusb_7706 | 865 |
| Lactobacillus | Ascusb_7723 | 866 |
| Flavobacterium | Ascusb_7728 | 867 |
| Victivallis | Ascusb_7733 | 868 |
| Clostridium_XIVa | Ascusb_7735 | 869 |
| Ureaplasma | Ascusb_7748 | 870 |
| Acetanaerobacterium | Ascusb_7752 | 871 |
| Slackia | Ascusb_7753 | 872 |
| Lachnospiracea_incertae_sedis | Ascusb_7761 | 873 |
| Oscillibacter | Ascusb_7763 | 874 |
| Prevotella | Ascusb_7765 | 875 |
| Proteiniphilum | Ascusb_7767 | 876 |
| Spirochaeta | Ascusb_7784 | 877 |
| Ruminococcus | Ascusb_7788 | 878 |
| Prevotella | Ascusb_7792 | 879 |
| Butyricicoccus | Ascusb_7796 | 880 |
| Devosia | Ascusb_7817 | 881 |
| Anaeroplasma | Ascusb_7828 | 882 |
| Oscillibacter | Ascusb_7829 | 883 |
| Barnesiella | Ascusb_7831 | 884 |
| Atopobium | Ascusb_7837 | 885 |
| Clostridium_XIVa | Ascusb_7838 | 886 |
| Methanobrevibacter | Ascusb_7839 | 887 |
| Butyricimonas | Ascusb_7849 | 888 |
| Butyricimonas | Ascusb_7853 | 889 |
| Asaccharobacter | Ascusb_7855 | 890 |
| Enhydrobacter | Ascusb_7871 | 891 |
| Treponema | Ascusb_7872 | 892 |
| Clostridium_XIVa | Ascusb_7873 | 893 |
| Adlercreutzia | Ascusb_7874 | 894 |
| Prevotella | Ascusb_7890 | 895 |
| Pseudoflavonifractor | Ascusb_7896 | 896 |
| Syntrophococcus | Ascusb_7898 | 897 |
| Clostridium_IV | Ascusb_7901 | 898 |
| Demequina | Ascusb_7902 | 899 |
| Lachnospiracea_incertae_sedis | Ascusb_7904 | 900 |
| Saccharofermentans | Ascusb_7924 | 901 |
| Sphaerisporangium | Ascusb_7925 | 902 |
| Anaeroplasma | Ascusb_7939 | 903 |
| Geobacillus | Ascusb_7958 | 904 |
| Prevotella | Ascusb_7959 | 905 |
| Clostridium_XIVa | Ascusb_7967 | 906 |
| Victivallis | Ascusb_7973 | 907 |
| Bacteroides | Ascusb_7989 | 908 |
| Demequina | Ascusb_7990 | 909 |
| Paraeggerthella | Ascusb_7994 | 910 |
| Paraprevotella | Ascusb_7996 | 911 |
| Pseudoflavonifractor | Ascusb_8013 | 912 |
| Roseburia | Ascusb_8018 | 913 |
| Gelidibacter | Ascusb_8038 | 914 |
| Clostridium_IV | Ascusb_8069 | 915 |

TABLE 3-continued

Bacteria of the present disclosure.

| Predicted Closest Taxa of Isolated Microbes | Strain Designation | Sequence Identifier |
|---|---|---|
| Rhizobium | Ascusb_8076 | 916 |
| Acholeplasma | Ascusb_8081 | 917 |
| Clostridium_XIVa | Ascusb_8084 | 918 |
| Bacteroides | Ascusb_8091 | 919 |
| Bacteroides | Ascusb_8105 | 920 |
| Papillibacter | Ascusb_8107 | 921 |
| Fusibacter | Ascusb_8113 | 922 |
| Coraliomargarita | Ascusb_8120 | 923 |
| Papillibacter | Ascusb_8123 | 924 |
| Clostridium_XIVa | Ascusb_8149 | 925 |
| Acholeplasma | Ascusb_8167 | 926 |
| Catenibacterium | Ascusb_8169 | 927 |
| Clostridium_IV | Ascusb_8172 | 928 |
| Clostridium_IV | Ascusb_8173 | 929 |
| Clostridium_IV | Ascusb_8179 | 930 |
| Nitrobacter | Ascusb_8182 | 931 |
| Victivallis | Ascusb_8189 | 932 |
| Selenomonas | Ascusb_8196 | 933 |
| Enterorhabdus | Ascusb_8200 | 934 |
| Eubacterium | Ascusb_8202 | 935 |
| Roseburia | Ascusb_8206 | 936 |
| Prevotella | Ascusb_8211 | 937 |
| Asaccharobacter | Ascusb_8222 | 938 |
| Bacteroides | Ascusb_8230 | 939 |
| Clostridium_XIVa | Ascusb_8238 | 940 |
| Gelidibacter | Ascusb_8245 | 941 |
| Brevundimonas | Ascusb_8254 | 942 |
| Clostridium_XIVa | Ascusb_8260 | 943 |
| Prevotella | Ascusb_8266 | 944 |
| Oscillibacter | Ascusb_8268 | 945 |
| Asteroleplasma | Ascusb_8280 | 946 |
| Anaeroplasma | Ascusb_8283 | 947 |
| Oscillibacter | Ascusb_8311 | 948 |
| Bilophila | Ascusb_8317 | 949 |
| Oscillibacter | Ascusb_8318 | 950 |
| Clostridium_IV | Ascusb_8320 | 951 |
| Prevotella | Ascusb_8321 | 952 |
| Geosporobacter | Ascusb_8329 | 953 |
| Butyricimonas | Ascusb_8363 | 954 |
| Pseudoflavonifractor | Ascusb_8366 | 955 |
| Barnesiella | Ascusb_8367 | 956 |
| Selenomonas | Ascusb_8370 | 957 |
| Prevotella | Ascusb_8374 | 958 |
| Enterorhabdus | Ascusb_8379 | 959 |
| Oscillibacter | Ascusb_8384 | 960 |
| Pelotomaculum | Ascusb_8394 | 961 |
| Cellulosilyticum | Ascusb_8396 | 962 |
| Clostridium_IV | Ascusb_8402 | 963 |
| Parabacteroides | Ascusb_8410 | 964 |
| Papillibacter | Ascusb_8413 | 965 |
| Bacteroides | Ascusb_8439 | 966 |
| Prevotella | Ascusb_8440 | 967 |
| Hydrogenoanaerobacterium | Ascusb_8447 | 968 |
| Clostridium_XIVa | Ascusb_8470 | 969 |
| Prevotella | Ascusb_8480 | 970 |
| Clostridium_IV | Ascusb_8484 | 971 |
| Howardella | Ascusb_8487 | 972 |
| Slackia | Ascusb_8498 | 973 |
| Methylobacter | Ascusb_8500 | 974 |
| Treponema | Ascusb_8508 | 975 |
| Clostridium_XIVa | Ascusb_8514 | 976 |
| Devosia | Ascusb_8518 | 977 |
| Ruminococcus | Ascusb_8537 | 978 |
| Lachnospiracea_incertae_sedis | Ascusb_8569 | 979 |
| Clostridium_III | Ascusb_8580 | 980 |
| Methanobrevibacter | Ascusb_8595 | 981 |
| Paraprevotella | Ascusb_8600 | 982 |
| Desulfobulbus | Ascusb_8627 | 983 |
| Butyricicoccus | Ascusb_8639 | 984 |
| Clostridium_XIVa | Ascusb_8657 | 985 |
| Dialister | Ascusb_8669 | 986 |
| Selenomonas | Ascusb_8681 | 987 |
| Spirochaeta | Ascusb_8696 | 988 |
| Clostridium_IV | Ascusb_8712 | 989 |
| Cellulosilyticum | Ascusb_8713 | 990 |
| Prevotella | Ascusb_8714 | 991 |
| Pseudoflavonifractor | Ascusb_8715 | 992 |
| Clostridium_III | Ascusb_8728 | 993 |
| Oscillibacter | Ascusb_8733 | 994 |
| Faecalibacterium | Ascusb_8746 | 995 |
| Clostridium_XIVb | Ascusb_8753 | 996 |
| Eubacterium | Ascusb_8758 | 997 |
| Clostridium_III | Ascusb_8762 | 998 |
| Prevotella | Ascusb_8769 | 999 |
| Paenibacillus | Ascusb_8771 | 1000 |
| Pedobacter | Ascusb_8782 | 1001 |
| Butyricicoccus | Ascusb_8786 | 1002 |
| Clostridium_XIVa | Ascusb_8787 | 1003 |
| Roseburia | Ascusb_8799 | 1004 |
| Hydrogenoanaerobacterium | Ascusb_8804 | 1005 |
| Adhaeribacter | Ascusb_8807 | 1006 |
| Eubacterium | Ascusb_8815 | 1007 |
| Bacteroides | Ascusb_8822 | 1008 |
| Victivallis | Ascusb_8835 | 1009 |
| Roseburia | Ascusb_8840 | 1010 |
| Treponema | Ascusb_8857 | 1011 |
| Prevotella | Ascusb_8860 | 1012 |
| Prevotella | Ascusb_8870 | 1013 |
| Hydrogenoanaerobacterium | Ascusb_8873 | 1014 |
| Clostridium_XIVa | Ascusb_8883 | 1015 |
| Bacteroides | Ascusb_8884 | 1016 |
| Bacteroides | Ascusb_8886 | 1017 |
| Lactobacillus | Ascusb_8888 | 1018 |
| Adlercreutzia | Ascusb_8892 | 1019 |
| Dethiosulfovibrio | Ascusb_8916 | 1020 |
| Lutispora | Ascusb_8934 | 1021 |
| Turicibacter | Ascusb_8942 | 1022 |
| Cyanobacteria | Ascusb_8953 | 1023 |
| Clostridium_sensu_stricto | Ascusb_8956 | 1024 |
| Cyanobacteria | Ascusb_8972 | 1025 |
| Bulleidia | Ascusb_9004 | 1026 |
| Aquiflexum | Ascusb_9015 | 1027 |
| Lachnospiracea_incertae_sedis | Ascusb_9026 | 1028 |
| Lachnospiracea_incertae_sedis | Ascusb_9073 | 1029 |
| Clostridium_III | Ascusb_9075 | 1030 |
| Roseburia | Ascusb_9081 | 1031 |
| Glaciecola | Ascusb_9086 | 1032 |
| Clostridium_XIVa | Ascusb_9090 | 1033 |
| Hydrogenoanaerobacterium | Ascusb_9095 | 1034 |
| Clostridium_IV | Ascusb_9097 | 1035 |
| Sphaerobacter | Ascusb_9098 | 1036 |
| Cyanobacteria | Ascusb_9105 | 1037 |
| Prevotella | Ascusb_9109 | 1038 |
| Turicibacter | Ascusb_9112 | 1039 |
| Ruminococcus | Ascusb_9122 | 1040 |
| Clostridium_IV | Ascusb_9131 | 1041 |
| Clostridium_XIVa | Ascusb_9145 | 1042 |
| Saccharofermentans | Ascusb_9151 | 1043 |
| Clostridium_XIVb | Ascusb_9154 | 1044 |
| Ruminococcus | Ascusb_9160 | 1045 |
| Fibrobacter | Ascusb_9169 | 1046 |
| Proteiniclasticum | Ascusb_9176 | 1047 |
| Anaeroplasma | Ascusb_9178 | 1048 |
| Cyanobacteria | Ascusb_9184 | 1049 |
| Algoriphagus | Ascusb_9189 | 1050 |
| Clostridium_XIVa | Ascusb_9196 | 1051 |
| Howardella | Ascusb_9200 | 1052 |
| Clostridium_XIVa | Ascusb_9201 | 1053 |
| Barnesiella | Ascusb_9211 | 1054 |
| Clostridium_IV | Ascusb_9234 | 1055 |
| Prevotella | Ascusb_9238 | 1056 |
| Clostridium_XIVa | Ascusb_9251 | 1057 |
| Butyricimonas | Ascusb_9261 | 1058 |
| Blautia | Ascusb_9264 | 1059 |
| Prevotella | Ascusb_9274 | 1060 |
| Clostridium_XIVa | Ascusb_9277 | 1061 |
| Blautia | Ascusb_9282 | 1062 |
| Clostridium_IV | Ascusb_9291 | 1063 |

TABLE 3-continued

Bacteria of the present disclosure.

| Predicted Closest Taxa of Isolated Microbes | Strain Designation | Sequence Identifier |
|---|---|---|
| Flavobacterium | Ascusb_9292 | 1064 |
| Prevotella | Ascusb_9300 | 1065 |
| Clostridium_XIVa | Ascusb_9301 | 1066 |
| Clostridium_XIVa | Ascusb_9302 | 1067 |
| Eubacterium | Ascusb_9313 | 1068 |
| Butyricicoccus | Ascusb_9340 | 1069 |
| Fluviicola | Ascusb_9343 | 1070 |
| Anaerovibrio | Ascusb_9354 | 1071 |
| Blautia | Ascusb_9355 | 1072 |
| Verrucomicrobia | Ascusb_9367 | 1073 |
| Clostridium_sensu_stricto | Ascusb_9368 | 1074 |
| Spirochaeta | Ascusb_9369 | 1075 |
| Clostridium_XI | Ascusb_9372 | 1076 |
| Anaerovorax | Ascusb_9376 | 1077 |
| Roseburia | Ascusb_9381 | 1078 |
| Mucilaginibacter | Ascusb_9388 | 1079 |
| Clostridium_XI | Ascusb_9389 | 1080 |
| Lachnospiracea_incertae_sedis | Ascusb_9401 | 1081 |
| Prevotella | Ascusb_9402 | 1082 |
| Clostridium_III | Ascusb_9411 | 1083 |
| Lachnospiracea_incertae_sedis | Ascusb_9415 | 1084 |
| Coprococcus | Ascusb_9427 | 1085 |
| Acholeplasma | Ascusb_9432 | 1086 |
| Clostridium_III | Ascusb_9453 | 1087 |
| Lactobacillus | Ascusb_9454 | 1088 |
| Clostridium_IV | Ascusb_9455 | 1089 |
| Prevotella | Ascusb_9465 | 1090 |
| Bifidobacterium | Ascusb_9497 | 1091 |
| Adhaeribacter | Ascusb_9507 | 1092 |
| Hydrogenoanaerobacterium | Ascusb_9518 | 1093 |
| Acetivibrio | Ascusb_9521 | 1094 |
| Cyanobacteria | Ascusb_9532 | 1095 |
| Flammeovirga | Ascusb_9535 | 1096 |
| Dethiosulfovibrio | Ascusb_9543 | 1097 |
| Hippea | Ascusb_9545 | 1098 |
| Faecalibacterium | Ascusb_9558 | 1099 |
| Spirochaeta | Ascusb_9559 | 1100 |
| Brevundimonas | Ascusb_9563 | 1101 |
| Mucilaginibacter | Ascusb_9564 | 1102 |
| Hydrogenoanaerobacterium | Ascusb_9580 | 1103 |
| Asaccharobacter | Ascusb_9587 | 1104 |
| Clostridium_IV | Ascusb_9591 | 1105 |
| Mogibacterium | Ascusb_9605 | 1106 |
| Clostridium_IV | Ascusb_9617 | 1107 |
| Oscillibacter | Ascusb_9619 | 1108 |
| Clostridium_XIVa | Ascusb_9628 | 1109 |
| Faecalibacterium | Ascusb_9640 | 1110 |
| Altererythrobacter | Ascusb_9644 | 1111 |
| Gelidibacter | Ascusb_9656 | 1112 |
| Prevotella | Ascusb_9662 | 1113 |
| Anaerovorax | Ascusb_9663 | 1114 |
| Riemerella | Ascusb_9664 | 1115 |
| Sphingobacterium | Ascusb_9666 | 1116 |
| Syntrophococcus | Ascusb_9668 | 1117 |
| Bacteroides | Ascusb_9669 | 1118 |
| Papillibacter | Ascusb_9678 | 1119 |
| Butyricicoccus | Ascusb_9679 | 1120 |
| Clostridium_IV | Ascusb_9680 | 1121 |
| Hydrogenoanaerobacterium | Ascusb_9684 | 1122 |
| Marvinbryantia | Ascusb_9688 | 1123 |
| Brevibacillus | Ascusb_9701 | 1124 |
| Clostridium_IV | Ascusb_9715 | 1125 |
| Prevotella | Ascusb_9719 | 1126 |
| Clostridium_IV | Ascusb_9734 | 1127 |
| Aminobacter | Ascusb_9759 | 1128 |
| Sporotomaculum | Ascusb_9764 | 1129 |
| Clostridium_IV | Ascusb_9779 | 1130 |
| Pedobacter | Ascusb_9780 | 1131 |
| Victivallis | Ascusb_9782 | 1132 |
| Gelidibacter | Ascusb_9792 | 1133 |
| Prevotella | Ascusb_9824 | 1134 |
| Wautersiella | Ascusb_9839 | 1135 |
| Slackia | Ascusb_9846 | 1136 |
| Pyramidobacter | Ascusb_9851 | 1137 |
| Lachnospiracea_incertae_sedis | Ascusb_9862 | 1138 |
| Clostridium_XIVa | Ascusb_9869 | 1139 |
| Prevotella | Ascusb_9876 | 1140 |
| Lentisphaera | Ascusb_9886 | 1141 |
| Desulfoluna | Ascusb_9895 | 1142 |
| Clostridium_III | Ascusb_9897 | 1143 |
| Clostridium_sensu_stricto | Ascusb_9925 | 1144 |
| Prevotella | Ascusb_9929 | 1145 |
| Clostridium_III | Ascusb_9934 | 1146 |
| Clostridium_IV | Ascusb_9949 | 1147 |
| Prevotella | Ascusb_9951 | 1148 |
| Cyanobacteria | Ascusb_9954 | 1149 |
| Helicobacter | Ascusb_9958 | 1150 |
| Clostridium_XIVa | Ascusb_9977 | 1151 |
| Coprococcus | Ascusb_9982 | 1152 |
| Bradyrhizobium | Ascusb_9993 | 1153 |
| Clostridium_IV | Ascusb_9996 | 1154 |
| Sphingobacterium | Ascusb_10002 | 1155 |
| Gelidibacter | Ascusb_10023 | 1156 |
| Vasilyevaea | Ascusb_10029 | 1157 |
| Eubacterium | Ascusb_10030 | 1158 |
| Clostridium_XIVa | Ascusb_10034 | 1159 |
| Eubacterium | Ascusb_10044 | 1160 |
| Syntrophococcus | Ascusb_10045 | 1161 |
| Prevotella | Ascusb_10050 | 1162 |
| Treponema | Ascusb_10057 | 1163 |
| Anaerovorax | Ascusb_10058 | 1164 |
| Erysipelotrichaceae_incertae_sedis | Ascusb_10059 | 1165 |
| Sulfurovum | Ascusb_10084 | 1166 |
| Clostridium_IV | Ascusb_10085 | 1167 |
| Papillibacter | Ascusb_10087 | 1168 |
| Paracoccus | Ascusb_10094 | 1169 |
| Hydrogenoanaerobacterium | Ascusb_10102 | 1170 |
| Adhaeribacter | Ascusb_10121 | 1171 |
| Lachnospiracea_incertae_sedis | Ascusb_10126 | 1172 |
| Bacteroides | Ascusb_10127 | 1173 |
| Hydrogenoanaerobacterium | Ascusb_10129 | 1174 |
| Telmatospirillum | Ascusb_10138 | 1175 |
| Clostridium_XIVa | Ascusb_10144 | 1176 |
| Hydrogenoanaerobacterium | Ascusb_10147 | 1177 |
| Clostridium_IV | Ascusb_10156 | 1178 |
| Vasilyevaea | Ascusb_10164 | 1179 |
| Anaeroplasma | Ascusb_10177 | 1180 |
| Sporotomaculum | Ascusb_10193 | 1181 |
| Clostridium_IV | Ascusb_10194 | 1182 |
| Enterorhabdus | Ascusb_10204 | 1183 |
| Bacteroides | Ascusb_10208 | 1184 |
| Anaerotruncus | Ascusb_10210 | 1185 |
| Rhodopirellula | Ascusb_10215 | 1186 |
| Clostridium_XIVa | Ascusb_10221 | 1187 |
| Gelidibacter | Ascusb_10243 | 1188 |
| Anaerofustis | Ascusb_10268 | 1189 |
| Butyricicoccus | Ascusb_10269 | 1190 |
| Butyricicoccus | Ascusb_10278 | 1191 |
| Clostridium_XIVa | Ascusb_10281 | 1192 |
| Cryptanaerobacter | Ascusb_10284 | 1193 |
| Clostridium_IV | Ascusb_10299 | 1194 |
| Mogibacterium | Ascusb_10309 | 1195 |
| Syntrophococcus | Ascusb_10313 | 1196 |
| Bacteroides | Ascusb_10325 | 1197 |
| Treponema | Ascusb_10327 | 1198 |
| Coraliomargarita | Ascusb_10344 | 1199 |
| Ruminococcus | Ascusb_10368 | 1200 |
| Prevotella | Ascusb_10374 | 1201 |
| Pseudaminobacter | Ascusb_10380 | 1202 |
| Prevotella | Ascusb_10392 | 1203 |
| Treponema | Ascusb_10450 | 1204 |
| Syntrophococcus | Ascusb_10456 | 1205 |
| Clostridium_IV | Ascusb_10457 | 1206 |
| Tenacibaculum | Ascusb_10462 | 1207 |
| Parabacteroides | Ascusb_10466 | 1208 |
| Luteimonas | Ascusb_10469 | 1209 |
| Eubacterium | Ascusb_10488 | 1210 |
| Roseburia | Ascusb_10495 | 1211 |

TABLE 3-continued

Bacteria of the present disclosure.

| Predicted Closest Taxa of Isolated Microbes | Strain Designation | Sequence Identifier |
|---|---|---|
| Oscillibacter | Ascusb_10504 | 1212 |
| Cyanobacteria | Ascusb_10529 | 1213 |
| Prevotella | Ascusb_10547 | 1214 |
| Clostridium_IV | Ascusb_10548 | 1215 |
| Treponema | Ascusb_10557 | 1216 |
| Clostridium_IV | Ascusb_10561 | 1217 |
| Victivallis | Ascusb_10562 | 1218 |
| Clostridium_XIVa | Ascusb_10576 | 1219 |
| Oscillibacter | Ascusb_10586 | 1220 |
| Papillibacter | Ascusb_10598 | 1221 |
| Cellulosilyticum | Ascusb_10604 | 1222 |
| Treponema | Ascusb_10607 | 1223 |
| Ruminococcus | Ascusb_10609 | 1224 |
| Coraliomargarita | Ascusb_10612 | 1225 |
| Butyricicoccus | Ascusb_10613 | 1226 |
| Blautia | Ascusb_10615 | 1227 |
| Lachnospiracea_incertae_sedis | Ascusb_10617 | 1228 |
| Prevotella | Ascusb_10622 | 1229 |
| Clostridium_IV | Ascusb_10623 | 1230 |
| Clostridium_IV | Ascusb_10635 | 1231 |
| Clostridium_III | Ascusb_10655 | 1232 |
| Neptunomonas | Ascusb_10677 | 1233 |
| Clostridium_IV | Ascusb_10682 | 1234 |
| Howardella | Ascusb_10685 | 1235 |
| Clostridium_IV | Ascusb_10687 | 1236 |
| Roseburia | Ascusb_10711 | 1237 |
| Oscillibacter | Ascusb_10739 | 1238 |
| Clostridium_XIVa | Ascusb_10740 | 1239 |
| Clostridium_IV | Ascusb_10741 | 1240 |
| Sporobacter | Ascusb_10749 | 1241 |
| Clostridium_XIVa | Ascusb_10769 | 1242 |
| Butyricicoccus | Ascusb_10774 | 1243 |
| Clostridium_XIVa | Ascusb_10787 | 1244 |
| Filomicrobium | Ascusb_10788 | 1245 |
| Bacteroides | Ascusb_10790 | 1246 |
| Clostridium_XIVa | Ascusb_10809 | 1247 |
| Brevundimonas | Ascusb_10812 | 1248 |
| Clostridium_IV | Ascusb_10817 | 1249 |
| Paracoccus | Ascusb_10818 | 1250 |
| Schlegelella | Ascusb_10837 | 1251 |
| Clostridium_XI | Ascusb_10844 | 1252 |
| Diaphorobacter | Ascusb_10847 | 1253 |
| Clostridium_sensu_stricto | Ascusb_10858 | 1254 |
| Saccharopolyspora | Ascusb_10863 | 1255 |
| Prevotella | Ascusb_10871 | 1256 |
| Eggerthella | Ascusb_10878 | 1257 |
| Gelidibacter | Ascusb_10888 | 1258 |
| Prevotella | Ascusb_10899 | 1259 |
| Pseudomonas | Ascusb_10922 | 1260 |
| Prevotella | Ascusb_10927 | 1261 |
| Prevotella | Ascusb_10937 | 1262 |
| Prevotella | Ascusb_10940 | 1263 |
| Brevundimonas | Ascusb_10945 | 1264 |
| Bacteroides | Ascusb_10982 | 1265 |
| Clostridium_XIVa | Ascusb_11015 | 1266 |
| Photobacterium | Ascusb_11027 | 1267 |
| Clostridium_XIVa | Ascusb_11031 | 1268 |
| Clostridium_XIVb | Ascusb_11032 | 1269 |
| Prevotella | Ascusb_11037 | 1270 |
| Clostridium_IV | Ascusb_11046 | 1271 |
| Anaeroplasma | Ascusb_11051 | 1272 |
| Caldilinea | Ascusb_11053 | 1273 |
| Clostridium_XIVa | Ascusb_11059 | 1274 |
| Victivallis | Ascusb_11061 | 1275 |
| Brevundimonas | Ascusb_11063 | 1276 |
| Cyanobacteria | Ascusb_11074 | 1277 |
| Prevotella | Ascusb_11120 | 1278 |
| Slackia | Ascusb_11124 | 1279 |
| Pedobacter | Ascusb_11125 | 1280 |
| Prevotella | Ascusb_11129 | 1281 |
| Trueperella | Ascusb_11141 | 1282 |
| Oscillibacter | Ascusb_11170 | 1283 |
| Cyanobacteria | Ascusb_11185 | 1284 |
| Victivallis | Ascusb_11199 | 1285 |
| Bacteroides | Ascusb_11200 | 1286 |
| Micrococcus | Ascusb_11207 | 1287 |
| Olivibacter | Ascusb_11209 | 1288 |
| Anaerophaga | Ascusb_11211 | 1289 |
| Selenomonas | Ascusb_11214 | 1290 |
| Megasphaera | Ascusb_11219 | 1291 |
| Clostridium_XIVa | Ascusb_11221 | 1292 |
| Clostridium_XIVa | Ascusb_11241 | 1293 |
| Eubacterium | Ascusb_11245 | 1294 |
| Cyanobacteria | Ascusb_11253 | 1295 |
| Clostridium_XIVa | Ascusb_11287 | 1296 |
| Treponema | Ascusb_11288 | 1297 |
| Cryptanaerobacter | Ascusb_11289 | 1298 |
| Xanthomonas | Ascusb_11301 | 1299 |
| Asteroleplasma | Ascusb_11302 | 1300 |
| Cyanobacteria | Ascusb_11315 | 1301 |
| Sporotomaculum | Ascusb_11321 | 1302 |
| Bacteroides | Ascusb_11324 | 1303 |
| Asaccharobacter | Ascusb_11330 | 1304 |
| Clostridium_IV | Ascusb_11343 | 1305 |
| Cyanobacteria | Ascusb_11348 | 1306 |
| Clostridium_XIVa | Ascusb_11362 | 1307 |
| Treponema | Ascusb_11365 | 1308 |
| Prevotella | Ascusb_11384 | 1309 |
| Turicibacter | Ascusb_11388 | 1310 |
| Clostridium_IV | Ascusb_11389 | 1311 |
| Clostridium_IV | Ascusb_11397 | 1312 |
| Clostridium_IV | Ascusb_11403 | 1313 |
| Oscillibacter | Ascusb_11410 | 1314 |
| Deinococcus | Ascusb_11423 | 1315 |
| Pedobacter | Ascusb_11427 | 1316 |
| Anaerovorax | Ascusb_11435 | 1317 |
| Clostridium_IV | Ascusb_11442 | 1318 |
| Bacteroides | Ascusb_11445 | 1319 |
| Clostridium_IV | Ascusb_11461 | 1320 |
| Rhodococcus | Ascusb_11463 | 1321 |
| Treponema | Ascusb_11464 | 1322 |
| Mucilaginibacter | Ascusb_11475 | 1323 |
| Clostridium_XIVa | Ascusb_11503 | 1324 |
| Olivibacter | Ascusb_11510 | 1325 |
| Clostridium_XIVa | Ascusb_11519 | 1326 |
| Barnesiella | Ascusb_11581 | 1327 |
| Clostridium_XIVb | Ascusb_11584 | 1328 |
| Gelidibacter | Ascusb_11600 | 1329 |
| Methanobrevibacter | Ascusb_11602 | 1330 |
| Anaerotruncus | Ascusb_11612 | 1331 |
| Lachnospiracea_incertae_sedis | Ascusb_11653 | 1332 |
| Erysipelotrichaceae_incertae_sedis | Ascusb_11656 | 1333 |
| Mesorhizobium | Ascusb_11681 | 1334 |
| Clostridium_XI | Ascusb_11695 | 1335 |
| Planctomyces | Ascusb_11698 | 1336 |
| Aerococcus | Ascusb_11713 | 1337 |
| Victivallis | Ascusb_11721 | 1338 |
| Cyanobacteria | Ascusb_11736 | 1339 |
| Bacteroides | Ascusb_11752 | 1340 |
| Clostridium_XI | Ascusb_11753 | 1341 |
| Clostridium_XIVa | Ascusb_11757 | 1342 |
| Ruminococcus | Ascusb_11761 | 1343 |
| Saccharofermentans | Ascusb_11780 | 1344 |
| Oscillibacter | Ascusb_11781 | 1345 |
| Lachnospiracea_incertae_sedis | Ascusb_11783 | 1346 |
| Fibrobacter | Ascusb_11793 | 1347 |
| Kiloniella | Ascusb_11809 | 1348 |
| Olivibacter | Ascusb_11819 | 1349 |
| Clostridium_IV | Ascusb_11821 | 1350 |
| Spirochaeta | Ascusb_11865 | 1351 |
| Prevotella | Ascusb_11870 | 1352 |
| Olivibacter | Ascusb_11881 | 1353 |
| Prevotella | Ascusb_11884 | 1354 |
| Parabacteroides | Ascusb_11885 | 1355 |
| Prevotella | Ascusb_11892 | 1356 |
| Leifsonia | Ascusb_11896 | 1357 |
| Clostridium_IV | Ascusb_11901 | 1358 |
| Victivallis | Ascusb_11903 | 1359 |

TABLE 3-continued

Bacteria of the present disclosure.

| Predicted Closest Taxa of Isolated Microbes | Strain Designation | Sequence Identifier |
|---|---|---|
| Treponema | Ascusb_11929 | 1360 |
| Cyanobacteria | Ascusb_11952 | 1361 |
| Sporotomaculum | Ascusb_11954 | 1362 |
| Spirochaeta | Ascusb_11955 | 1363 |
| Clostridium_III | Ascusb_11960 | 1364 |
| Clostridium_XIVa | Ascusb_11962 | 1365 |
| Anaerovorax | Ascusb_11963 | 1366 |
| Oscillibacter | Ascusb_11964 | 1367 |
| Victivallis | Ascusb_11988 | 1368 |
| Lachnospiracea_incertae_sedis | Ascusb_11993 | 1369 |
| Spirochaeta | Ascusb_11997 | 1370 |
| Clostridium_XIVb | Ascusb_12000 | 1371 |
| Oscillibacter | Ascusb_12004 | 1372 |
| Prevotella | Ascusb_12013 | 1373 |
| Anaeroplasma | Ascusb_12046 | 1374 |
| Adlercreutzia | Ascusb_12054 | 1375 |
| Clostridium_XIVa | Ascusb_12061 | 1376 |
| Beijerinckia | Ascusb_12069 | 1377 |
| Prevotella | Ascusb_12106 | 1378 |
| Coprococcus | Ascusb_12110 | 1379 |
| Lentisphaera | Ascusb_12116 | 1380 |
| Clostridium_XIVa | Ascusb_12119 | 1381 |
| Saccharofermentans | Ascusb_12127 | 1382 |
| Porphyrobacter | Ascusb_12128 | 1383 |
| Rhodobacter | Ascusb_12140 | 1384 |
| Oscillibacter | Ascusb_12153 | 1385 |
| Roseburia | Ascusb_12160 | 1386 |
| Prevotella | Ascusb_12175 | 1387 |
| Aquiflexum | Ascusb_12177 | 1388 |
| Rhodopirellula | Ascusb_12187 | 1389 |
| Bacteroides | Ascusb_12191 | 1390 |
| Bacteroides | Ascusb_12216 | 1391 |
| Clostridium_XIVa | Ascusb_12221 | 1392 |
| Clostridium_IV | Ascusb_12227 | 1393 |
| Prevotella | Ascusb_12243 | 1394 |
| Mogibacterium | Ascusb_12248 | 1395 |
| Prevotella | Ascusb_12252 | 1396 |
| Clostridium_XIVa | Ascusb_12269 | 1397 |
| Prevotella | Ascusb_12270 | 1398 |
| Capnocytophaga | Ascusb_12276 | 1399 |
| Acholeplasma | Ascusb_12282 | 1400 |
| Clostridium_IV | Ascusb_12310 | 1401 |
| Succinivibrio | Ascusb_12327 | 1402 |
| Pseudonocardia | Ascusb_12339 | 1403 |
| Clostridium_XIVa | Ascusb_12353 | 1404 |
| Butyricimonas | Ascusb_12354 | 1405 |
| Anaerovorax | Ascusb_12355 | 1406 |
| Prevotella | Ascusb_12383 | 1407 |
| Butyricimonas | Ascusb_12399 | 1408 |
| Parabacteroides | Ascusb_12407 | 1409 |
| Clostridium_XIVa | Ascusb_12413 | 1410 |
| Clostridium_XIVb | Ascusb_12417 | 1411 |
| Bacteroides | Ascusb_12428 | 1412 |
| Cyanobacteria | Ascusb_12452 | 1413 |
| Riemerella | Ascusb_12461 | 1414 |
| Anaeroplasma | Ascusb_12487 | 1415 |
| Ruminococcus | Ascusb_12489 | 1416 |
| Verrucomicrobia | Ascusb_12499 | 1417 |
| Lachnospiracea_incertae_sedis | Ascusb_12511 | 1418 |
| Syntrophococcus | Ascusb_12512 | 1419 |
| Clostridium_IV | Ascusb_12520 | 1420 |
| Barnesiella | Ascusb_12534 | 1421 |
| Olivibacter | Ascusb_12553 | 1422 |
| Clostridium_XIVa | Ascusb_12574 | 1423 |
| Cryptanaerobacter | Ascusb_12577 | 1424 |
| Saccharofermentans | Ascusb_12578 | 1425 |
| Clostridium_IV | Ascusb_12599 | 1426 |
| Coprococcus | Ascusb_12600 | 1427 |
| Barnesiella | Ascusb_12606 | 1428 |
| Clostridium_sensu_stricto | Ascusb_12618 | 1429 |
| Hydrogenoanaerobacterium | Ascusb_12627 | 1430 |
| Clostridium_XIVb | Ascusb_12628 | 1431 |
| Selenomonas | Ascusb_12661 | 1432 |
| Prevotella | Ascusb_12662 | 1433 |
| Hydrogenoanaerobacterium | Ascusb_12679 | 1434 |
| Spirochaeta | Ascusb_12703 | 1435 |
| Enterorhabdus | Ascusb_12704 | 1436 |
| Thermoanaerobacter | Ascusb_12709 | 1437 |
| Armatimonadetes | Ascusb_12719 | 1438 |
| Syntrophococcus | Ascusb_12723 | 1439 |
| Sphingobium | Ascusb_12731 | 1440 |
| Clostridium_XIVa | Ascusb_12737 | 1441 |
| Geosporobacter | Ascusb_12740 | 1442 |
| Enterorhabdus | Ascusb_12746 | 1443 |
| Verrucomicrobia | Ascusb_12747 | 1444 |
| Clostridium_XIVa | Ascusb_12749 | 1445 |
| Parabacteroides | Ascusb_12750 | 1446 |
| Cryptanaerobacter | Ascusb_12769 | 1447 |
| Anaeroplasma | Ascusb_12775 | 1448 |
| Spirochaeta | Ascusb_12779 | 1449 |
| Prevotella | Ascusb_12804 | 1450 |
| Roseburia | Ascusb_12819 | 1451 |
| Pedobacter | Ascusb_12826 | 1452 |
| Pedobacter | Ascusb_12835 | 1453 |
| Eggerthella | Ascusb_12838 | 1454 |
| Prevotella | Ascusb_12853 | 1455 |
| Rikenella | Ascusb_12873 | 1456 |
| Anaerophaga | Ascusb_12894 | 1457 |
| Spirochaeta | Ascusb_12901 | 1458 |
| Clostridium_IV | Ascusb_12910 | 1459 |
| Weissella | Ascusb_12931 | 1460 |
| Butyricicoccus | Ascusb_12946 | 1461 |
| Hahella | Ascusb_12953 | 1462 |
| Acholeplasma | Ascusb_12960 | 1463 |
| Clostridium_XIVa | Ascusb_12962 | 1464 |
| Cellulosilyticum | Ascusb_12987 | 1465 |
| Verrucomicrobia | Ascusb_12995 | 1466 |
| Clostridium_XIVa | Ascusb_13002 | 1467 |
| Pseudoflavonifractor | Ascusb_13028 | 1468 |
| Calditerricola | Ascusb_13035 | 1469 |
| Clostridium_IV | Ascusb_13039 | 1470 |
| Clostridium_IV | Ascusb_13050 | 1471 |
| Adlercreutzia | Ascusb_13054 | 1472 |
| Bulleidia | Ascusb_13088 | 1473 |
| Lachnospiracea_incertae_sedis | Ascusb_13089 | 1474 |
| Mucilaginibacter | Ascusb_13115 | 1475 |
| Victivallis | Ascusb_13128 | 1476 |
| Anaerovorax | Ascusb_13130 | 1477 |
| Clostridium_XIVb | Ascusb_13134 | 1478 |
| Clostridium_XIVa | Ascusb_13154 | 1479 |
| Prevotella | Ascusb_13155 | 1480 |
| Bacteroides | Ascusb_13163 | 1481 |
| Schwartzia | Ascusb_13165 | 1482 |
| Pyramidobacter | Ascusb_13226 | 1483 |
| Eubacterium | Ascusb_13230 | 1484 |
| Lachnospiracea_incertae_sedis | Ascusb_13244 | 1485 |
| Clostridium_XIVa | Ascusb_13249 | 1486 |
| Roseburia | Ascusb_13254 | 1487 |
| Clostridium_XIVb | Ascusb_13276 | 1488 |
| Enterorhabdus | Ascusb_13284 | 1489 |
| Pedobacter | Ascusb_13291 | 1490 |
| Clostridium_sensu_stricto | Ascusb_13296 | 1491 |
| Clostridium_XIVa | Ascusb_13328 | 1492 |
| Clostridium_III | Ascusb_13343 | 1493 |
| Desulfotomaculum | Ascusb_13349 | 1494 |
| Clostridium_IV | Ascusb_13353 | 1495 |
| Proteiniclasticum | Ascusb_13371 | 1496 |
| Prevotella | Ascusb_13412 | 1497 |
| Faecalibacterium | Ascusb_13417 | 1498 |
| Microbacterium | Ascusb_13419 | 1499 |
| Leucobacter | Ascusb_13424 | 1500 |
| Prevotella | Ascusb_13426 | 1501 |
| Sphingobacterium | Ascusb_13457 | 1502 |
| Fusibacter | Ascusb_13458 | 1503 |
| Howardella | Ascusb_13463 | 1504 |
| Pedobacter | Ascusb_13488 | 1505 |
| Caldilinea | Ascusb_13504 | 1506 |
| Turicibacter | Ascusb_13513 | 1507 |

TABLE 3-continued

Bacteria of the present disclosure.

| Predicted Closest Taxa of Isolated Microbes | Strain Designation | Sequence Identifier |
|---|---|---|
| Clostridium_IV | Ascusb_13516 | 1508 |
| Alistipes | Ascusb_13546 | 1509 |
| Clostridium_XIVa | Ascusb_13547 | 1510 |
| Clostridium_XIVa | Ascusb_13567 | 1511 |
| Prevotella | Ascusb_13597 | 1512 |
| Clostridium_XIVa | Ascusb_13611 | 1513 |
| Butyricimonas | Ascusb_13648 | 1514 |
| Anaerovibrio | Ascusb_13663 | 1515 |
| Prevotella | Ascusb_13675 | 1516 |
| Pseudoflavonifractor | Ascusb_13679 | 1517 |
| Corynebacterium | Ascusb_13763 | 1518 |
| Leucobacter | Ascusb_13780 | 1519 |
| Kerstersia | Ascusb_13819 | 1520 |
| Slackia | Ascusb_13835 | 1521 |
| Lactococcus | Ascusb_13839 | 1522 |
| Prevotella | Ascusb_13840 | 1523 |
| Clostridium_IV | Ascusb_13845 | 1524 |
| Prevotella | Ascusb_13848 | 1525 |
| Bacteroides | Ascusb_13867 | 1526 |
| Lactobacillus | Ascusb_13881 | 1527 |
| Prevotella | Ascusb_13892 | 1528 |
| Clostridium_XIVa | Ascusb_13895 | 1529 |
| Clostridium_sensu_stricto | Ascusb_13903 | 1530 |
| Syntrophococcus | Ascusb_13904 | 1531 |
| Clostridium_XIVa | Ascusb_13921 | 1532 |
| Victivallis | Ascusb_13923 | 1533 |
| Bacteroides | Ascusb_13940 | 1534 |
| Acidobacteria | Ascusb_13951 | 1535 |
| Clostridium_XIVa | Ascusb_13953 | 1536 |
| Prevotella | Ascusb_13954 | 1537 |
| Verrucomicrobia | Ascusb_13955 | 1538 |
| Clostridium_XIVa | Ascusb_13981 | 1539 |
| Treponema | Ascusb_13982 | 1540 |
| Pyramidobacter | Ascusb_13983 | 1541 |
| Robinsoniella | Ascusb_13992 | 1542 |
| Lachnospiracea_incertae_sedis | Ascusb_13995 | 1543 |
| Clostridium_XI | Ascusb_13996 | 1544 |
| Bifidobacterium | Ascusb_14005 | 1545 |
| Bacteroides | Ascusb_14013 | 1546 |
| Gordonibacter | Ascusb_14016 | 1547 |
| Enterorhabdus | Ascusb_14055 | 1548 |
| Lactobacillus | Ascusb_14059 | 1549 |
| Bacteroides | Ascusb_14074 | 1550 |
| Prevotella | Ascusb_14086 | 1551 |
| Tannerella | Ascusb_14141 | 1552 |
| Bacteroides | Ascusb_14145 | 1553 |
| Prevotella | Ascusb_14151 | 1554 |
| Clostridium_XIVb | Ascusb_14163 | 1555 |
| Gelidibacter | Ascusb_14189 | 1556 |
| Cyanobacteria | Ascusb_14213 | 1557 |
| Rhodoplanes | Ascusb_14224 | 1558 |
| Selenomonas | Ascusb_14226 | 1559 |
| Escherichia/Shigella | Ascusb_14256 | 1560 |
| Rikenella | Ascusb_14278 | 1561 |
| Coprococcus | Ascusb_14285 | 1562 |
| Clostridium_sensu_stricto | Ascusb_14290 | 1563 |
| Hyphomicrobium | Ascusb_14304 | 1564 |
| Erysipelotrichaceae_incertae_sedis | Ascusb_14320 | 1565 |
| Verrucomicrobia | Ascusb_14324 | 1566 |
| Staphylococcus | Ascusb_14335 | 1567 |
| Verrucomicrobia | Ascusb_14358 | 1568 |
| Victivallis | Ascusb_14359 | 1569 |
| Selenomonas | Ascusb_14423 | 1570 |
| Desulfobulbus | Ascusb_14425 | 1571 |
| Clostridium_III | Ascusb_14450 | 1572 |
| Spirochaeta | Ascusb_14451 | 1573 |
| Kordia | Ascusb_14514 | 1574 |
| Bosea | Ascusb_14521 | 1575 |
| Enterococcus | Ascusb_14525 | 1576 |
| Clostridium_III | Ascusb_14530 | 1577 |
| Xanthobacter | Ascusb_14538 | 1578 |
| Lactobacillus | Ascusb_14555 | 1579 |
| Prevotella | Ascusb_14583 | 1580 |
| Acidaminococcus | Ascusb_14595 | 1581 |
| Eubacterium | Ascusb_14596 | 1582 |
| Bacteroides | Ascusb_14611 | 1583 |
| Clostridium_XIVa | Ascusb_14613 | 1584 |
| Lactobacillus | Ascusb_14626 | 1585 |
| Devosia | Ascusb_14628 | 1586 |
| Pedobacter | Ascusb_14667 | 1587 |
| Clostridium_IV | Ascusb_14747 | 1588 |
| Clostridium_XIVa | Ascusb_14785 | 1589 |
| Corynebacterium | Ascusb_14790 | 1590 |
| Spirochaeta | Ascusb_14792 | 1591 |
| Anaeroplasma | Ascusb_14828 | 1592 |
| Clostridium_XIVa | Ascusb_14869 | 1593 |
| Lachnospiracea_incertae_sedis | Ascusb_14888 | 1594 |
| Saccharofermentans | Ascusb_14898 | 1595 |
| Slackia | Ascusb_14906 | 1596 |
| Limibacter | Ascusb_14951 | 1597 |
| Sphingobium | Ascusb_14952 | 1598 |
| Clostridium_XIVa | Ascusb_14987 | 1599 |
| Riemerella | Ascusb_14990 | 1600 |
| Saccharofermentans | Ascusb_15032 | 1601 |
| Bacteroides | Ascusb_15048 | 1602 |
| Prevotella | Ascusb_15076 | 1603 |
| Selenomonas | Ascusb_15097 | 1604 |
| Victivallis | Ascusb_15122 | 1605 |
| Howardella | Ascusb_15128 | 1606 |
| Pelospora | Ascusb_15132 | 1607 |
| Clostridium_sensu_stricto | Ascusb_15151 | 1608 |
| Selenomonas | Ascusb_15156 | 1609 |
| Fibrobacter | Ascusb_15181 | 1610 |
| Clostridium_III | Ascusb_15215 | 1611 |
| Sphingomonas | Ascusb_15220 | 1612 |
| Selenomonas | Ascusb_15226 | 1613 |
| Eggerthella | Ascusb_15326 | 1614 |
| Treponema | Ascusb_15352 | 1615 |
| Mogibacterium | Ascusb_15357 | 1616 |
| Adlercreutzia | Ascusb_15390 | 1617 |
| Selenomonas | Ascusb_15394 | 1618 |
| Methylomicrobium | Ascusb_15404 | 1619 |
| Leuconostoc | Ascusb_15413 | 1620 |
| Pyramidobacter | Ascusb_15427 | 1621 |
| Butyrivibrio | Ascusb_15438 | 1622 |
| Bacteroides | Ascusb_15454 | 1623 |
| Butyricimonas | Ascusb_15455 | 1624 |
| Ruminococcus | Ascusb_15461 | 1625 |
| Clostridium_sensu_stricto | Ascusb_15482 | 1626 |
| Butyrivibrio | Ascusb_15488 | 1627 |
| Corynebacterium | Ascusb_15494 | 1628 |
| Proteiniborus | Ascusb_15526 | 1629 |
| Spirochaeta | Ascusb_15539 | 1630 |
| Acetitomaculum | Ascusb_15549 | 1631 |
| Selenomonas | Ascusb_15552 | 1632 |
| Altererythrobacter | Ascusb_15556 | 1633 |
| Atopobium | Ascusb_15587 | 1634 |
| Clostridium_IV | Ascusb_15615 | 1635 |
| Clostridium_XIVa | Ascusb_15624 | 1636 |
| Clostridium_XIVa | Ascusb_15695 | 1637 |
| Clostridium_IV | Ascusb_15703 | 1638 |
| Clostridium_III | Ascusb_15720 | 1639 |
| Candidate phylumTM7 | Ascusb_15737 | 1640 |
| Desulfotomaculum | Ascusb_15741 | 1641 |
| Pedobacter | Ascusb_15746 | 1642 |
| Bacteroides | Ascusb_15750 | 1643 |
| Asaccharobacter | Ascusb_15754 | 1644 |
| Microbacterium | Ascusb_15768 | 1645 |
| Treponema | Ascusb_15824 | 1646 |
| Dethiosulfovibrio | Ascusb_15830 | 1647 |
| Oscillibacter | Ascusb_15832 | 1648 |
| Selenomonas | Ascusb_15846 | 1649 |
| Eubacterium | Ascusb_15864 | 1650 |
| Ruminococcus | Ascusb_15877 | 1651 |
| Treponema | Ascusb_15915 | 1652 |
| Spirochaeta | Ascusb_15951 | 1653 |
| Roseburia | Ascusb_15963 | 1654 |
| Ruminococcus | Ascusb_15992 | 1655 |

TABLE 3-continued

Bacteria of the present disclosure.

| Predicted Closest Taxa of Isolated Microbes | Strain Designation | Sequence Identifier |
|---|---|---|
| Butyricimonas | Ascusb_16010 | 1656 |
| Pedobacter | Ascusb_16051 | 1657 |
| Spirochaeta | Ascusb_16066 | 1658 |
| Parabacteroides | Ascusb_16101 | 1659 |
| Methylococcus | Ascusb_16111 | 1660 |
| Enterorhabdus | Ascusb_16113 | 1661 |
| Clostridium_sensu_stricto | Ascusb_16124 | 1662 |
| Gelidibacter | Ascusb_16149 | 1663 |
| Sporobacter | Ascusb_16168 | 1664 |
| Pedobacter | Ascusb_16185 | 1665 |
| Cyanobacteria | Ascusb_16194 | 1666 |
| Syntrophococcus | Ascusb_16198 | 1667 |
| Slackia | Ascusb_16200 | 1668 |
| Mogibacterium | Ascusb_16215 | 1669 |
| Prevotella | Ascusb_16239 | 1670 |
| Pseudoflavonifractor | Ascusb_16244 | 1671 |
| Veillonella | Ascusb_16257 | 1672 |
| Clostridium_XIVa | Ascusb_16278 | 1673 |
| Bacillus | Ascusb_16299 | 1674 |
| Pedobacter | Ascusb_16316 | 1675 |
| Clostridium_IV | Ascusb_16329 | 1676 |
| Fibrobacter | Ascusb_16330 | 1677 |
| Paenibacillus | Ascusb_16336 | 1678 |
| Brevundimonas | Ascusb_16345 | 1679 |
| Desulfovibrio | Ascusb_16373 | 1680 |
| Clostridium_XI | Ascusb_16374 | 1681 |
| Helicobacter | Ascusb_16383 | 1682 |
| Prevotella | Ascusb_16420 | 1683 |
| Clostridium_XIVa | Ascusb_16423 | 1684 |
| Prevotella | Ascusb_16436 | 1685 |
| Herbiconiux | Ascusb_16453 | 1686 |
| Clostridium_IV | Ascusb_16461 | 1687 |
| Rikenella | Ascusb_16470 | 1688 |
| Clostridium_XIVa | Ascusb_16473 | 1689 |
| Hippea | Ascusb_16536 | 1690 |
| Lactobacillus | Ascusb_16537 | 1691 |
| Eubacterium | Ascusb_16541 | 1692 |
| Clostridium_IV | Ascusb_16546 | 1693 |
| Clostridium_III | Ascusb_16560 | 1694 |
| Lactobacillus | Ascusb_16565 | 1695 |
| Lactobacillus | Ascusb_16574 | 1696 |
| Desulfotomaculum | Ascusb_16578 | 1697 |
| Prevotella | Ascusb_16618 | 1698 |
| Staphylococcus | Ascusb_16628 | 1699 |
| Tenacibaculum | Ascusb_16632 | 1700 |
| Parabacteroides | Ascusb_16655 | 1701 |
| Clostridium_XIVa | Ascusb_16668 | 1702 |
| Clostridium_IV | Ascusb_16671 | 1703 |
| Clostridium_IV | Ascusb_16674 | 1704 |
| Pedobacter | Ascusb_16682 | 1705 |
| Helicobacter | Ascusb_16686 | 1706 |
| Proteiniclasticum | Ascusb_16691 | 1707 |
| Anaplasma | Ascusb_16711 | 1708 |
| Bacteroides | Ascusb_16734 | 1709 |
| Clostridium_IV | Ascusb_16749 | 1710 |
| Mucilaginibacter | Ascusb_16803 | 1711 |
| Verrucomicrobia | Ascusb_16829 | 1712 |
| Selenomonas | Ascusb_16884 | 1713 |
| Parabacteroides | Ascusb_16931 | 1714 |
| Eubacterium | Ascusb_16933 | 1715 |
| Coprococcus | Ascusb_16948 | 1716 |
| Weissella | Ascusb_16968 | 1717 |
| Pedobacter | Ascusb_16992 | 1718 |
| Clostridium_XI | Ascusb_16995 | 1719 |
| Sphingomonas | Ascusb_16998 | 1720 |
| Treponema | Ascusb_17013 | 1721 |
| Geobacter | Ascusb_17017 | 1722 |
| Clostridium_XIVa | Ascusb_17018 | 1723 |
| Filomicrobium | Ascusb_17036 | 1724 |
| Prevotella | Ascusb_17038 | 1725 |
| Pedobacter | Ascusb_17057 | 1726 |
| Pedobacter | Ascusb_17058 | 1727 |
| Clostridium_XIVa | Ascusb_17064 | 1728 |
| Bifidobacterium | Ascusb_17066 | 1729 |
| Saccharofermentans | Ascusb_17092 | 1730 |
| Ruminococcus | Ascusb_17136 | 1731 |
| Flavobacterium | Ascusb_17138 | 1732 |
| Rhodopirellula | Ascusb_17161 | 1733 |
| Roseburia | Ascusb_17171 | 1734 |
| Prevotella | Ascusb_17177 | 1735 |
| Limibacter | Ascusb_17182 | 1736 |
| Saccharofermentans | Ascusb_17203 | 1737 |
| Clostridium_sensu_stricto | Ascusb_17206 | 1738 |
| Clostridium_III | Ascusb_17243 | 1739 |
| Prevotella | Ascusb_17275 | 1740 |
| Pseudoxanthomonas | Ascusb_17283 | 1741 |
| Anaerorhabdus | Ascusb_17325 | 1742 |
| Clostridium_III | Ascusb_17360 | 1743 |
| Streptomyces | Ascusb_17372 | 1744 |
| Pedobacter | Ascusb_17388 | 1745 |
| Cellulomonas | Ascusb_17414 | 1746 |
| Clostridium_XIVa | Ascusb_17416 | 1747 |
| Olivibacter | Ascusb_17425 | 1748 |
| Treponema | Ascusb_17433 | 1749 |
| Gelidibacter | Ascusb_17437 | 1750 |
| Ruminococcus | Ascusb_17439 | 1751 |
| Clostridium_IV | Ascusb_17446 | 1752 |
| Gemmatimonas | Ascusb_17450 | 1753 |
| Prevotella | Ascusb_17459 | 1754 |
| Ethanoligenens | Ascusb_17477 | 1755 |
| Leucobacter | Ascusb_17494 | 1756 |
| Clostridium_XIVa | Ascusb_17502 | 1757 |
| Clostridium_XIVa | Ascusb_17507 | 1758 |
| Eggerthella | Ascusb_17540 | 1759 |
| Prevotella | Ascusb_17553 | 1760 |
| Prevotella | Ascusb_17569 | 1761 |
| Solobacterium | Ascusb_17571 | 1762 |
| Xanthobacter | Ascusb_17581 | 1763 |
| Verrucomicrobia | Ascusb_17649 | 1764 |
| Desulfovibrio | Ascusb_17670 | 1765 |
| Microbacterium | Ascusb_17717 | 1766 |
| Oscillibacter | Ascusb_17718 | 1767 |
| Blautia | Ascusb_17735 | 1768 |
| Papillibacter | Ascusb_17736 | 1769 |
| Prevotella | Ascusb_17759 | 1770 |
| Lentisphaera | Ascusb_17766 | 1771 |
| Ruminococcus | Ascusb_17767 | 1772 |
| Bacteroides | Ascusb_17769 | 1773 |
| Catonella | Ascusb_17771 | 1774 |
| Clostridium_XIVa | Ascusb_17773 | 1775 |
| Clostridium_IV | Ascusb_17782 | 1776 |
| Verrucomicrobia | Ascusb_17802 | 1777 |
| Clostridium_XI | Ascusb_17804 | 1778 |
| Prevotella | Ascusb_17810 | 1779 |
| Candidate phylumTM7 | Ascusb_17824 | 1780 |
| Mogibacterium | Ascusb_17838 | 1781 |
| Clostridium_XIVa | Ascusb_17846 | 1782 |
| Ruminococcus | Ascusb_17857 | 1783 |
| Eubacterium | Ascusb_17866 | 1784 |
| Clostridium_IV | Ascusb_17892 | 1785 |
| Rhodomicrobium | Ascusb_17896 | 1786 |
| Butyricicoccus | Ascusb_17957 | 1787 |
| Saccharofermentans | Ascusb_17975 | 1788 |
| Prevotella | Ascusb_17978 | 1789 |
| Mannheimia | Ascusb_17981 | 1790 |
| Lactobacillus | Ascusb_18078 | 1791 |
| Clostridium_IV | Ascusb_18081 | 1792 |
| Clostridium_IV | Ascusb_18091 | 1793 |
| Adlercreutzia | Ascusb_18107 | 1794 |
| Selenomonas | Ascusb_18110 | 1795 |
| Paenibacillus | Ascusb_18123 | 1796 |
| Clostridium_IV | Ascusb_18140 | 1797 |
| Paenibacillus | Ascusb_18148 | 1798 |
| Butyricimonas | Ascusb_18161 | 1799 |
| Wandonia | Ascusb_18170 | 1800 |
| Puniceicoccus | Ascusb_18179 | 1801 |
| Lactonifactor | Ascusb_18183 | 1802 |
| Selenomonas | Ascusb_18248 | 1803 |

TABLE 3-continued

Bacteria of the present disclosure.

| Predicted Closest Taxa of Isolated Microbes | Strain Designation | Sequence Identifier |
|---|---|---|
| Brevundimonas | Ascusb_18262 | 1804 |
| Prevotella | Ascusb_18273 | 1805 |
| Gelidibacter | Ascusb_18283 | 1806 |
| Mogibacterium | Ascusb_18287 | 1807 |
| Clostridium_XIVa | Ascusb_18303 | 1808 |
| Coprococcus | Ascusb_18329 | 1809 |
| Verrucomicrobia | Ascusb_18335 | 1810 |
| Barnesiella | Ascusb_18339 | 1811 |
| Verrucomicrobia | Ascusb_18351 | 1812 |
| Clostridium_XIVa | Ascusb_18354 | 1813 |
| Anaerovorax | Ascusb_18371 | 1814 |
| Bacteroides | Ascusb_18389 | 1815 |
| Parasporobacterium | Ascusb_18444 | 1816 |
| Prevotella | Ascusb_18449 | 1817 |
| Parapedobacter | Ascusb_18475 | 1818 |
| Streptomyces | Ascusb_18495 | 1819 |
| Candidate phylumTM7 | Ascusb_18503 | 1820 |
| Thermotalea | Ascusb_18516 | 1821 |
| Alkaliflexus | Ascusb_18519 | 1822 |
| Oscillibacter | Ascusb_18557 | 1823 |
| Anaerotruncus | Ascusb_18564 | 1824 |
| Spirochaeta | Ascusb_18566 | 1825 |
| Clostridium_XI | Ascusb_18567 | 1826 |
| Sporotomaculum | Ascusb_18585 | 1827 |
| Sporacetigenium | Ascusb_18592 | 1828 |
| Bulleidia | Ascusb_18608 | 1829 |
| Clostridium_IV | Ascusb_18636 | 1830 |
| Syntrophomonas | Ascusb_18648 | 1831 |
| Desulfatiferula | Ascusb_18678 | 1832 |
| Hydrogenoanaerobacterium | Ascusb_18680 | 1833 |
| Clostridium_XIVa | Ascusb_18695 | 1834 |
| Mogibacterium | Ascusb_18731 | 1835 |
| Spirochaeta | Ascusb_18733 | 1836 |
| Prevotella | Ascusb_18735 | 1837 |
| Treponema | Ascusb_18738 | 1838 |
| Spiroplasma | Ascusb_18764 | 1839 |
| Clostridium_XIVa | Ascusb_18766 | 1840 |
| Bacteroides | Ascusb_18795 | 1841 |
| Treponema | Ascusb_18814 | 1842 |
| Selenomonas | Ascusb_18829 | 1843 |
| Butyricicoccus | Ascusb_18846 | 1844 |
| Gelidibacter | Ascusb_18866 | 1845 |
| Acetitomaculum | Ascusb_18876 | 1846 |
| Proteiniclasticum | Ascusb_18907 | 1847 |
| Papillibacter | Ascusb_18930 | 1848 |
| Prevotella | Ascusb_18949 | 1849 |
| Elusimicrobium | Ascusb_18970 | 1850 |
| Lachnospiracea_incertae_sedis | Ascusb_18998 | 1851 |
| Devosia | Ascusb_19006 | 1852 |
| Roseburia | Ascusb_19052 | 1853 |
| Mucilaginibacter | Ascusb_19054 | 1854 |
| Mogibacterium | Ascusb_19056 | 1855 |
| Saccharofermentans | Ascusb_19063 | 1856 |
| Paenibacillus | Ascusb_19092 | 1857 |
| Anaerotruncus | Ascusb_19101 | 1858 |
| Leucobacter | Ascusb_19114 | 1859 |
| Clostridium_XIVa | Ascusb_19148 | 1860 |
| Eubacterium | Ascusb_19160 | 1861 |
| Beijerinckia | Ascusb_19170 | 1862 |
| Prevotella | Ascusb_19200 | 1863 |
| Clostridium_III | Ascusb_19206 | 1864 |
| Cyanobacteria | Ascusb_19219 | 1865 |
| Pseudoflavonifractor | Ascusb_19237 | 1866 |
| Butyrivibrio | Ascusb_19245 | 1867 |
| Acholeplasma | Ascusb_19267 | 1868 |
| Filomicrobium | Ascusb_19288 | 1869 |
| Clostridium_III | Ascusb_19335 | 1870 |
| Pseudoflavonifractor | Ascusb_19340 | 1871 |
| Anaerophaga | Ascusb_19341 | 1872 |
| Lachnospiracea_incertae_sedis | Ascusb_19347 | 1873 |
| Asaccharobacter | Ascusb_19353 | 1874 |
| Kordia | Ascusb_19371 | 1875 |
| Ruminococcus | Ascusb_19376 | 1876 |
| Clostridium_III | Ascusb_19379 | 1877 |
| Ethanoligenens | Ascusb_19392 | 1878 |
| Clostridium_XIVa | Ascusb_19412 | 1879 |
| Barnesiella | Ascusb_19414 | 1880 |
| Eubacterium | Ascusb_19444 | 1881 |
| Prevotella | Ascusb_19457 | 1882 |
| Anaerophaga | Ascusb_19496 | 1883 |
| Acetitomaculum | Ascusb_19498 | 1884 |
| Prevotella | Ascusb_19503 | 1885 |
| Clostridium_III | Ascusb_19507 | 1886 |
| Marinoscillum | Ascusb_19558 | 1887 |
| Pedobacter | Ascusb_19568 | 1888 |
| Prevotella | Ascusb_19579 | 1889 |
| Prevotella | Ascusb_19613 | 1890 |
| Anaerovorax | Ascusb_19633 | 1891 |
| Clostridium_XIVa | Ascusb_19658 | 1892 |
| Clostridium_IV | Ascusb_19662 | 1893 |
| Lachnospiracea_incertae_sedis | Ascusb_19681 | 1894 |
| Clostridium_sensu_stricto | Ascusb_19694 | 1895 |
| Lishizhenia | Ascusb_19698 | 1896 |
| Pedobacter | Ascusb_19700 | 1897 |
| Howardella | Ascusb_19731 | 1898 |
| Roseburia | Ascusb_19745 | 1899 |
| Clostridium_XIVa | Ascusb_19754 | 1900 |
| Anaerovorax | Ascusb_19765 | 1901 |
| Lentisphaera | Ascusb_19772 | 1902 |
| Prevotella | Ascusb_19778 | 1903 |
| Saccharofermentans | Ascusb_19779 | 1904 |
| Cyanobacteria | Ascusb_19818 | 1905 |
| Proteiniphilum | Ascusb_19824 | 1906 |
| Schwartzia | Ascusb_19855 | 1907 |
| Anaerorhabdus | Ascusb_19884 | 1908 |
| Robinsoniella | Ascusb_19885 | 1909 |
| Clostridium_IV | Ascusb_19904 | 1910 |
| Erysipelotrichaceae_incertae_sedis | Ascusb_19936 | 1911 |
| Flavobacterium | Ascusb_19950 | 1912 |
| Pedobacter | Ascusb_19955 | 1913 |
| Clostridium_III | Ascusb_19982 | 1914 |
| Selenomonas | Ascusb_20001 | 1915 |
| Rhizobium | Ascusb_20027 | 1916 |
| Victivallis | Ascusb_20044 | 1917 |
| Butyricimonas | Ascusb_20062 | 1918 |
| Parabacteroides | Ascusb_20064 | 1919 |
| Adhaeribacter | Ascusb_20067 | 1920 |
| Eubacterium | Ascusb_20086 | 1921 |
| Acidobacteria | Ascusb_20100 | 1922 |
| Treponema | Ascusb_20104 | 1923 |
| Clostridium_XIVa | Ascusb_20108 | 1924 |
| Clostridium_XIVa | Ascusb_20135 | 1925 |
| Schwartzia | Ascusb_20143 | 1926 |
| Prevotella | Ascusb_20162 | 1927 |
| Selenomonas | Ascusb_20172 | 1928 |
| Beijerinckia | Ascusb_20219 | 1929 |
| Eubacterium | Ascusb_20221 | 1930 |
| Adhaeribacter | Ascusb_20251 | 1931 |
| Verrucomicrobia | Ascusb_20264 | 1932 |
| Desulfobulbus | Ascusb_20275 | 1933 |
| Bacteroides | Ascusb_20278 | 1934 |
| Rummeliibacillus | Ascusb_20291 | 1935 |
| Agarivorans | Ascusb_20293 | 1936 |
| Clostridium_XIVa | Ascusb_20306 | 1937 |
| Selenomonas | Ascusb_20312 | 1938 |
| Verrucomicrobia | Ascusb_20365 | 1939 |
| Prevotella | Ascusb_20368 | 1940 |
| Spirochaeta | Ascusb_20392 | 1941 |
| Selenomonas | Ascusb_20405 | 1942 |
| Spiroplasma | Ascusb_20424 | 1943 |
| Pedobacter | Ascusb_20440 | 1944 |
| Clostridium_XIVa | Ascusb_20449 | 1945 |
| Cyanobacteria | Ascusb_20456 | 1946 |
| Lactobacillus | Ascusb_20463 | 1947 |
| Clostridium_XIVa | Ascusb_20529 | 1948 |
| Prevotella | Ascusb_20534 | 1949 |
| Prevotella | Ascusb_20540 | 1950 |
| Marinobacter | Ascusb_20569 | 1951 |

TABLE 3-continued

Bacteria of the present disclosure.

| Predicted Closest Taxa of Isolated Microbes | Strain Designation | Sequence Identifier |
|---|---|---|
| Butyricimonas | Ascusb_20576 | 1952 |
| Prevotella | Ascusb_20594 | 1953 |
| Dongia | Ascusb_20595 | 1954 |
| Anaerovorax | Ascusb_20639 | 1955 |
| Butyricimonas | Ascusb_20757 | 1956 |
| Cryptanaerobacter | Ascusb_20826 | 1957 |
| Papillibacter | Ascusb_20904 | 1958 |
| Clostridium_sensu_stricto | Ascusb_20938 | 1959 |
| Escherichia/Shigella | Ascusb_20943 | 1960 |
| Butyricicoccus | Ascusb_20986 | 1961 |
| Prevotella | Ascusb_21013 | 1962 |
| Lachnospiracea_incertae_sedis | Ascusb_21027 | 1963 |
| Thermotalea | Ascusb_21035 | 1964 |
| Cohaesibacter | Ascusb_21042 | 1965 |
| Clostridium_XVIII | Ascusb_21043 | 1966 |
| Lachnospiracea_incertae_sedis | Ascusb_21085 | 1967 |
| Spirochaeta | Ascusb_21095 | 1968 |
| Clostridium_XIVa | Ascusb_21112 | 1969 |
| Hydrogenoanaerobacterium | Ascusb_21147 | 1970 |
| Clostridium_IV | Ascusb_21151 | 1971 |
| Papillibacter | Ascusb_21160 | 1972 |
| Sporosarcina | Ascusb_21190 | 1973 |
| Selenomonas | Ascusb_21219 | 1974 |
| Papillibacter | Ascusb_21229 | 1975 |
| Lachnospiracea_incertae_sedis | Ascusb_21244 | 1976 |
| Clostridium_XIVa | Ascusb_21271 | 1977 |
| Saccharofermentans | Ascusb_21297 | 1978 |
| Clostridium_IV | Ascusb_21309 | 1979 |
| Lachnospiracea_incertae_sedis | Ascusb_21348 | 1980 |
| Clostridium_IV | Ascusb_21425 | 1981 |
| Lachnospiracea_incertae_sedis | Ascusb_21436 | 1982 |
| Desulfotomaculum | Ascusb_21466 | 1983 |
| Pedobacter | Ascusb_21484 | 1984 |
| Anaeroplasma | Ascusb_21546 | 1985 |
| Clostridium_IV | Ascusb_21585 | 1986 |
| Treponema | Ascusb_21595 | 1987 |
| Mogibacterium | Ascusb_21601 | 1988 |

BRIEF DESCRIPTION OF THE FIGURES

FIG. 3A reveals the average number of pounds of milk fat produced over time; FIG. 3B reveals the average number of pounds of milk protein produced over time; and FIG. 3C reveals the average number of pounds of energy corrected milk (ECM) produced over time. The vertical line intersecting the data points in each of FIG. 3A, FIG. 3B, and FIG. 3C marks the day at which administration of the microbial bioconsortia ceased.

FIG. 8A and FIG. 8B depict the shared percent similarity (percent identity) among the bacteria (FIG. 8A) and fungi (FIG. 8B) of Table 1. The data points represent the greatest percent similarity pairing for each strain.

DETAILED DESCRIPTION

Definitions

Figure 1:
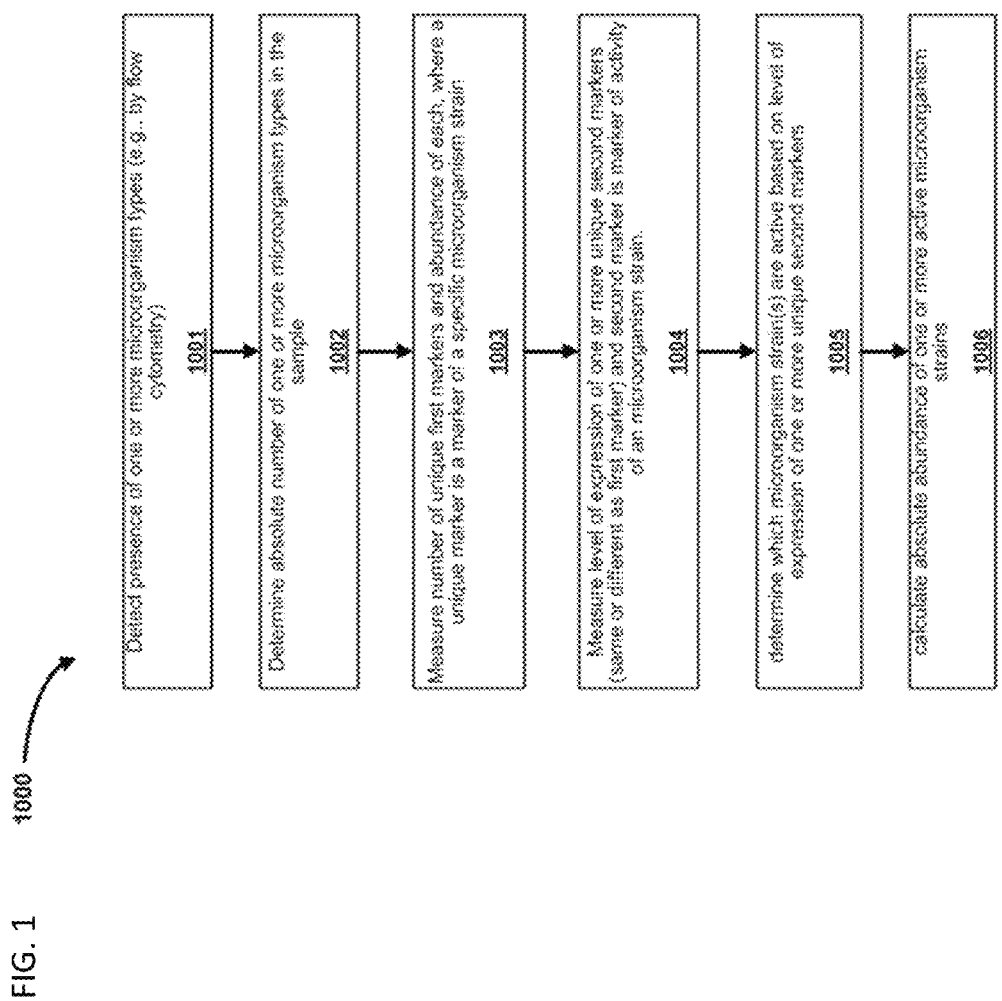
FIG. 1 shows a general workflow of one embodiment of the method for determining the absolute abundance of one or more active microorganism strains.

While the following terms are believed to be well understood by one of ordinary skill in the art, the following definitions are set forth to facilitate explanation of the presently disclosed subject matter.

The term "a" or "an" may refer to one or more of that entity, i.e. can refer to plural referents. As such, the terms "a" or "an", "one or more" and "at least one" are used interchangeably herein. In addition, reference to "an element" by the indefinite article "a" or "an" does not exclude the possibility that more than one of the elements is present, unless the context clearly requires that there is one and only one of the elements.

Reference throughout this specification to "one embodiment", "an embodiment", "one aspect", or "an aspect" means that a particular feature, structure or characteristic described in connection with the embodiment is included in at least one embodiment of the present disclosure. Thus, the appearances of the phrases "in one embodiment" or "in an embodiment" in various places throughout this specification are not necessarily all referring to the same embodiment. Furthermore, the particular features, structures, or characteristics can be combined in any suitable manner in one or more embodiments.

As used herein, in particular embodiments, the terms "about" or "approximately" when preceding a numerical value indicates the value plus or minus a range of 10%.

As used herein the terms "microorganism" or "microbe" should be taken broadly. These terms are used interchangeably and include, but are not limited to, the two prokaryotic domains, Bacteria and Archaea, eukaryotic fungi and protists, as well as viruses. In some embodiments, the disclosure refers to the "microbes" of Table 1 or Table 3, or the "microbes" incorporated by reference. This characterization can refer to not only the predicted taxonomic microbial identifiers of the table, but also the identified strains of the microbes listed in the table.

The term "microbial consortia" or "microbial consortium" refers to a subset of a microbial community of individual microbial species, or strains of a species, which can be described as carrying out a common function, or can be described as participating in, or leading to, or correlating with, a recognizable parameter, such as a phenotypic trait of interest (e.g. increased milk production in a ruminant). The community may comprise two or more species, or strains of a species, of microbes. In some instances, the microbes coexist within the community symbiotically.

The term "microbial community" means a group of microbes comprising two or more species or strains. Unlike microbial consortia, a microbial community does not have to be carrying out a common function, or does not have to be participating in, or leading to, or correlating with, a recognizable parameter, such as a phenotypic trait of interest (e.g. increased milk production in a ruminant).

As used herein, "isolate," "isolated," "isolated microbe," and like terms, are intended to mean that the one or more microorganisms has been separated from at least one of the materials with which it is associated in a particular environment (for example soil, water, animal tissue).

Microbes of the present disclosure may include spores and/or vegetative cells. In some embodiments, microbes of the present disclosure include microbes in a viable but non-culturable (VBNC) state. See Liao and Zhao (US Publication US2015267163A1). In some embodiments, microbes of the present disclosure include microbes in a biofilm. See Merritt et al. (U.S. Pat. No. 7,427,408).

Thus, an "isolated microbe" does not exist in its naturally occurring environment; rather, it is through the various techniques described herein that the microbe has been removed from its natural setting and placed into a non-naturally occurring state of existence. Thus, the isolated strain or isolated microbe may exist as, for example, a biologically pure culture, or as spores (or other forms of the strain) in association with an acceptable carrier.

As used herein, "spore" or "spores" refer to structures produced by bacteria and fungi that are adapted for survival and dispersal. Spores are generally characterized as dormant structures, however spores are capable of differentiation through the process of germination. Germination is the differentiation of spores into vegetative cells that are capable of metabolic activity, growth, and reproduction. The germination of a single spore results in a single fungal or bacterial vegetative cell. Fungal spores are units of asexual reproduction, and in some cases are necessary structures in fungal life cycles. Bacterial spores are structures for surviving conditions that may ordinarily be nonconductive to the survival or growth of vegetative cells.

As used herein, "microbial composition" refers to a composition comprising one or more microbes of the present disclosure, wherein a microbial composition, in some embodiments, is administered to animals of the present disclosure.

As used herein, "carrier", "acceptable carrier", or "pharmaceutical carrier" refers to a diluent, adjuvant, excipient, or vehicle with which the compound is administered. Such carriers can be sterile liquids, such as water and oils, including those of petroleum, animal, vegetable, or synthetic origin; such as peanut oil, soybean oil, mineral oil, sesame oil, and the like. Water or aqueous solution saline solutions and aqueous dextrose and glycerol solutions are preferably employed as carriers, in some embodiments as injectable solutions. Alternatively, the carrier can be a solid dosage form carrier, including but not limited to one or more of a binder (for compressed pills), a glidant, an encapsulating agent, a flavorant, and a colorant. The choice of carrier can be selected with regard to the intended route of administration and standard pharmaceutical practice. See Hardee and Baggo (1998. Development and Formulation of Veterinary Dosage Forms. $2^{nd}$ Ed. CRC Press. 504 pg.); E. W. Martin (1970. Remington's Pharmaceutical Sciences. $17^{th}$ Ed. Mack Pub. Co.); and Blaser et al. (US Publication US20110280840A1).

In certain aspects of the disclosure, the isolated microbes exist as isolated and biologically pure cultures. It will be appreciated by one of skill in the art, that an isolated and biologically pure culture of a particular microbe, denotes that said culture is substantially free (within scientific reason) of other living organisms and contains only the individual microbe in question. The culture can contain varying concentrations of said microbe. The present disclosure notes that isolated and biologically pure microbes often "necessarily differ from less pure or impure materials." See, e.g. *In re Bergstrom*, 427 F.2d 1394, (CCPA 1970)(discussing purified prostaglandins), see also, *In re Bergy*, 596 F.2d 952 (CCPA 1979)(discussing purified microbes), see also, *Parke-Davis & Co. v. H.K. Mulford & Co.*, 189 F. 95 (S.D.N.Y. 1911) (Learned Hand discussing purified adrenaline), aff'd in part, rev'd in part, 196 F. 496 (2d Cir. 1912), each of which are incorporated herein by reference. Furthermore, in some aspects, the disclosure provides for certain quantitative measures of the concentration, or purity limitations, that must be found within an isolated and biologically pure microbial culture. The presence of these purity values, in certain embodiments, is a further attribute that distinguishes the presently disclosed microbes from those microbes existing in a natural state. See, e.g., *Merck & Co. v. Olin Mathieson Chemical Corp.*, 253 F.2d 156 (4th Cir. 1958) (discussing purity limitations for vitamin B12 produced by microbes), incorporated herein by reference.

As used herein, "individual isolates" should be taken to mean a composition, or culture, comprising a predominance of a single genera, species, or strain, of microorganism, following separation from one or more other microorganisms. The phrase should not be taken to indicate the extent to which the microorganism has been isolated or purified. However, "individual isolates" can comprise substantially only one genus, species, or strain, of microorganism.

As used herein, "microbiome" refers to the collection of microorganisms that inhabit the digestive tract or gastrointestinal tract of an animal (including the rumen if said animal is a ruminant) and the microorgansims' physical environment (i.e. the microbiome has a biotic and physical component). The microbiome is fluid and may be modulated by numerous naturally occurring and artificial conditions (e.g., change in diet, disease, antimicrobial agents, influx of additional microorganisms, etc.). The modulation of the microbiome of a rumen that can be achieved via administration of the compositions of the disclosure, can take the form of: (a) increasing or decreasing a particular Family, Genus, Species, or functional grouping of microbe (i.e. alteration of the biotic component of the rumen microbiome) and/or (b) increasing or decreasing volatile fatty acids in the rumen, increasing or decreasing rumen pH, increasing or decreasing any other physical parameter important for rumen health (i.e. alteration of the abiotic component of the rumen mircrobiome).

As used herein, "probiotic" refers to a substantially pure microbe (i.e., a single isolate) or a mixture of desired microbes, and may also include any additional components that can be administered to a mammal for restoring microbiota. Probiotics or microbial inoculant compositions of the invention may be administered with an agent to allow the microbes to survive the environment of the gastrointestinal tract, i.e., to resist low pH and to grow in the gastrointestinal environment. In some embodiments, the present compositions (e.g., microbial compositions) are probiotics in some aspects.

As used herein, "prebiotic" refers to an agent that increases the number and/or activity of one or more desired microbes. Non-limiting examples of prebiotics that may be useful in the methods of the present disclosure include fructooligosaccharides (e.g., oligofructose, inulin, inulin-type fructans), galactooligosaccharides, amino acids, alcohols, and mixtures thereof. See Ramirez-Farias et al. (2008. *Br. J. Nutr.* 4:1-10) and Pool-Zobel and Sauer (2007. *J. Nutr.* 137:2580-2584 and supplemental).

The term "growth medium" as used herein, is any medium which is suitable to support growth of a microbe. By way of example, the media may be natural or artificial including gastrin supplemental agar, LB media, blood serum, and tissue culture gels. It should be appreciated that the media may be used alone or in combination with one or more other media. It may also be used with or without the addition of exogenous nutrients.

The medium may be amended or enriched with additional compounds or components, for example, a component which may assist in the interaction and/or selection of specific groups of microorganisms. For example, antibiotics (such as penicillin) or sterilants (for example, quaternary ammonium salts and oxidizing agents) could be present and/or the physical conditions (such as salinity, nutrients (for example organic and inorganic minerals (such as phosphorus, nitrogenous salts, ammonia, potassium and micronutrients such as cobalt and magnesium), pH, and/or temperature) could be amended.

As used herein, the term "ruminant" includes mammals that are capable of acquiring nutrients from plant-based food by fermenting it in a specialized stomach (rumen) prior to digestion, principally through microbial actions. Ruminants included cattle, goats, sheep, giraffes, yaks, deer, antelope, and others.

As used herein, the term "bovid" includes any member of family Bovidae, which include hoofed mammals such as antelope, sheep, goats, and cattle, among others.

As used herein, "energy-corrected milk" or "ECM" represents the amount of energy in milk based upon milk volume, milk fat, and milk protein. ECM adjusts the milk components to 3.5% fat and 3.2% protein, thus equalizing animal performance and allowing for comparison of production at the individual animal and herd levels over time. An equation used to calculate ECM, as related to the present disclosure, is:

$$ECM=(0.327 \times \text{milk pounds})+(12.95 \times \text{fat pounds})+(7.2 \times \text{protein pounds})$$

As used herein, "improved" should be taken broadly to encompass improvement of a characteristic of interest, as compared to a control group, or as compared to a known average quantity associated with the characteristic in question. For example, "improved" milk production associated with application of a beneficial microbe, or consortia, of the disclosure can be demonstrated by comparing the milk produced by an ungulate treated by the microbes taught herein to the milk of an ungulate not treated. In the present disclosure, "improved" does not necessarily demand that the data be statistically significant (i.e. p<0.05); rather, any quantifiable difference demonstrating that one value (e.g. the average treatment value) is different from another (e.g. the average control value) can rise to the level of "improved."

As used herein, "inhibiting and suppressing" and like terms should not be construed to require complete inhibition or suppression, although this may be desired in some embodiments.

The term "marker" or "unique marker" as used herein is an indicator of unique microorganism type, microorganism strain or activity of a microorganism strain. A marker can be measured in biological samples and includes without limitation, a nucleic acid-based marker such as a ribosomal RNA gene, a peptide- or protein-based marker, and/or a metabolite or other small molecule marker.

The term "metabolite" as used herein is an intermediate or product of metabolism. A metabolite in one embodiment is a small molecule. Metabolites have various functions, including in fuel, structural, signaling, stimulatory and inhibitory effects on enzymes, as a cofactor to an enzyme, in defense, and in interactions with other organisms (such as pigments, odorants and pheromones). A primary metabolite is directly involved in normal growth, development and reproduction. A secondary metabolite is not directly involved in these processes but usually has an important ecological function. Examples of metabolites include but are not limited to antibiotics and pigments such as resins and terpenes, etc. Some antibiotics use primary metabolites as precursors, such as actinomycin which is created from the primary metabolite, tryptophan. Metabolites, as used herein, include small, hydrophilic carbohydrates; large, hydrophobic lipids and complex natural compounds.

As used herein, the term "genotype" refers to the genetic makeup of an individual cell, cell culture, tissue, organism, or group of organisms.

As used herein, the term "allele(s)" means any of one or more alternative forms of a gene, all of which alleles relate to at least one trait or characteristic. In a diploid cell, the two alleles of a given gene occupy corresponding loci on a pair of homologous chromosomes. Since the present disclosure, in embodiments, relates to QTLs, i.e. genomic regions that may comprise one or more genes or regulatory sequences, it is in some instances more accurate to refer to "haplotype" (i.e. an allele of a chromosomal segment) instead of "allele", however, in those instances, the term "allele" should be understood to comprise the term "haplotype". Alleles are considered identical when they express a similar phenotype. Differences in sequence are possible but not important as long as they do not influence phenotype.

As used herein, the term "locus" (loci plural) means a specific place or places or a site on a chromosome where for example a gene or genetic marker is found.

As used herein, the term "genetically linked" refers to two or more traits that are co-inherited at a high rate during breeding such that they are difficult to separate through crossing.

A "recombination" or "recombination event" as used herein refers to a chromosomal crossing over or independent assortment. The term "recombinant" refers to an organism having a new genetic makeup arising as a result of a recombination event.

As used herein, the term "molecular marker" or "genetic marker" refers to an indicator that is used in methods for visualizing differences in characteristics of nucleic acid sequences. Examples of such indicators are restriction fragment length polymorphism (RFLP) markers, amplified fragment length polymorphism (AFLP) markers, single nucleotide polymorphisms (SNPs), insertion mutations, microsatellite markers (SSRs), sequence-characterized amplified regions (SCARs), cleaved amplified polymorphic sequence (CAPS) markers or isozyme markers or combinations of the markers described herein which defines a specific genetic and chromosomal location. Markers further include polynucleotide sequences encoding 16S or 18S rRNA, and internal transcribed spacer (ITS) sequences, which are sequences found between small-subunit and large-subunit rRNA genes that have proven to be especially useful in elucidating relationships or distinctions among when compared against one another. Mapping of molecular markers in the vicinity of an allele is a procedure which can be performed by the average person skilled in molecular-biological techniques.

The primary structure of major rRNA subunit 16S comprise a particular combination of conserved, variable, and hypervariable regions that evolve at different rates and enable the resolution of both very ancient lineages such as domains, and more modern lineages such as genera. The secondary structure of the 16S subunit include approximately 50 helices which result in base pairing of about 67% of the residues. These highly conserved secondary structural features are of great functional importance and can be used to ensure positional homology in multiple sequence alignments and phylogenetic analysis. Over the previous few decades, the 16S rRNA gene has become the most sequenced taxonomic marker and is the cornerstone for the current systematic classification of bacteria and archaea (Yarza et al. 2014. *Nature Rev. Micro.* 12:635-45).

A sequence identity of 94.5% or lower for two 16S rRNA genes is strong evidence for distinct genera, 86.5% or lower is strong evidence for distinct families, 82% or lower is strong evidence for distinct orders, 78.5% is strong evidence for distinct classes, and 75% or lower is strong evidence for distinct phyla. The comparative analysis of 16S rRNA gene sequences enables the establishment of taxonomic thresholds that are useful not only for the classification of cultured microorganisms but also for the classification of the many environmental sequences. Yarza et al. 2014. *Nature Rev. Micro.* 12:635-45).

As used herein, the term "trait" refers to a characteristic or phenotype. For example, in the context of some embodiments of the present disclosure, quantity of milk fat produced relates to the amount of triglycerides, triacylglycerides, diacylglycerides, monoacylglycerides, phospholipids, cholesterol, glycolipids, and fatty acids present in milk. Desirable traits may also include other milk characteristics, including but not limited to: predominance of short chain fatty acids, medium chain fatty acids, and long chain fatty acids; quantity of carbohydrates such as lactose, glucose, galactose, and other oligosaccharides; quantity of proteins such as caseins and whey; quantity of vitamins, minerals, milk yield/volume; reductions in methane emissions or manure; improved efficiency of nitrogen utilization; improved dry matter intake; improved feed efficiency and digestibility; increased degradation of cellulose, lignin, and hemicellulose; increased rumen concentrations of fatty acids such as acetic acid, propionic acid, and butyric acid; etc.

A trait may be inherited in a dominant or recessive manner, or in a partial or incomplete-dominant manner. A trait may be monogenic (i.e. determined by a single locus) or polygenic (i.e. determined by more than one locus) or may also result from the interaction of one or more genes with the environment.

In the context of this disclosure, traits may also result from the interaction of one or more mammalian genes and one or more microorganism genes.

As used herein, the term "homozygous" means a genetic condition existing when two identical alleles reside at a specific locus, but are positioned individually on corresponding pairs of homologous chromosomes in the cell of a diploid organism. Conversely, as used herein, the term "heterozygous" means a genetic condition existing when two different alleles reside at a specific locus, but are positioned individually on corresponding pairs of homologous chromosomes in the cell of a diploid organism.

As used herein, the term "phenotype" refers to the observable characteristics of an individual cell, cell culture, organism (e.g., a ruminant), or group of organisms which results from the interaction between that individual's genetic makeup (i.e., genotype) and the environment.

As used herein, the term "chimeric" or "recombinant" when describing a nucleic acid sequence or a protein sequence refers to a nucleic acid, or a protein sequence, that links at least two heterologous polynucleotides, or two heterologous polypeptides, into a single macromolecule, or that re-arranges one or more elements of at least one natural nucleic acid or protein sequence. For example, the term "recombinant" can refer to an artificial combination of two otherwise separated segments of sequence, e.g., by chemical synthesis or by the manipulation of isolated segments of nucleic acids by genetic engineering techniques.

As used herein, a "synthetic nucleotide sequence" or "synthetic polynucleotide sequence" is a nucleotide sequence that is not known to occur in nature or that is not naturally occurring. Generally, such a synthetic nucleotide sequence will comprise at least one nucleotide difference when compared to any other naturally occurring nucleotide sequence.

As used herein, the term "nucleic acid" refers to a polymeric form of nucleotides of any length, either ribonucleotides or deoxyribonucleotides, or analogs thereof. This term refers to the primary structure of the molecule, and thus includes double- and single-stranded DNA, as well as double- and single-stranded RNA. It also includes modified nucleic acids such as methylated and/or capped nucleic acids, nucleic acids containing modified bases, backbone modifications, and the like. The terms "nucleic acid" and "nucleotide sequence" are used interchangeably.

As used herein, the term "gene" refers to any segment of DNA associated with a biological function. Thus, genes include, but are not limited to, coding sequences and/or the regulatory sequences required for their expression. Genes can also include non-expressed DNA segments that, for example, form recognition sequences for other proteins. Genes can be obtained from a variety of sources, including cloning from a source of interest or synthesizing from known or predicted sequence information, and may include sequences designed to have desired parameters.

As used herein, the term "homologous" or "homologue" or "ortholog" is known in the art and refers to related sequences that share a common ancestor or family member and are determined based on the degree of sequence identity. The terms "homology," "homologous," "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant disclosure such as deletion or insertion of one or more nucleotides that do not substantially alter the functional properties of the resulting nucleic acid fragment relative to the initial, unmodified fragment. It is therefore understood, as those skilled in the art will appreciate, that the disclosure encompasses more than the specific exemplary sequences. These terms describe the relationship between a gene found in one species, subspecies, variety, cultivar or strain and the corresponding or equivalent gene in another species, subspecies, variety, cultivar or strain. For purposes of this disclosure homologous sequences are compared. "Homologous sequences" or "homologues" or "orthologs" are thought, believed, or known to be functionally related. A functional relationship may be indicated in any one of a number of ways, including, but not limited to: (a) degree of sequence identity and/or (b) the same or similar biological function. Preferably, both (a) and (b) are indicated. Homology can be determined using software programs readily available in the art, such as those discussed in Current Protocols in Molecular Biology (F. M. Ausubel et al., eds., 1987) Supplement 30, section 7.718, Table 7.71. Some alignment programs are MacVector (Oxford Molecular Ltd, Oxford, U.K.), ALIGN Plus (Scientific and Educational Software, Pennsylvania) and AlignX (Vector NTI, Invitrogen, Carlsbad, Calif.). Another alignment program is Sequencher (Gene Codes, Ann Arbor, Mich.), using default parameters.

As used herein, the term "nucleotide change" refers to, e.g., nucleotide substitution, deletion, and/or insertion, as is well understood in the art. For example, mutations contain alterations that produce silent substitutions, additions, or deletions, but do not alter the properties or activities of the encoded protein or how the proteins are made.

As used herein, the term "protein modification" refers to, e.g., amino acid substitution, amino acid modification, deletion, and/or insertion, as is well understood in the art.

As used herein, the term "at least a portion" or "fragment" of a nucleic acid or polypeptide means a portion having the minimal size characteristics of such sequences, or any larger fragment of the full length molecule, up to and including the full length molecule. A fragment of a polynucleotide of the disclosure may encode a biologically active portion of a genetic regulatory element. A biologically active portion of a genetic regulatory element can be prepared by isolating a portion of one of the polynucleotides of the disclosure that comprises the genetic regulatory element and assessing activity as described herein. Similarly, a portion of a polypeptide may be 4 amino acids, 5 amino acids, 6 amino acids, 7 amino acids, and so on, going up to the full length polypeptide. The length of the portion to be used will depend on the particular application. A portion of a nucleic acid useful as a hybridization probe may be as short as 12 nucleotides; in some embodiments, it is 20 nucleotides. A portion of a polypeptide useful as an epitope may be as short as 4 amino acids. A portion of a polypeptide that performs the function of the full-length polypeptide would generally be longer than 4 amino acids.

Variant polynucleotides also encompass sequences derived from a mutagenic and recombinogenic procedure such as DNA shuffling. Strategies for such DNA shuffling are known in the art. See, for example, Stemmer (1994) PNAS 91:10747-10751; Stemmer (1994) Nature 370:389-391; Crameri et al. (1997) Nature Biotech. 15:436-438; Moore et al. (1997) J. Mol. Biol. 272:336-347; Zhang et al. (1997) PNAS 94:4504-4509; Crameri et al. (1998) Nature 391:288-291; and U.S. Pat. Nos. 5,605,793 and 5,837,458. For PCR amplifications of the polynucleotides disclosed herein, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook et al. (1989) Molecular Cloning: A Laboratory Manual (2nd ed., Cold Spring Harbor Laboratory Press, Plainview, N.Y.). See also Innis et al., eds. (1990) PCR Protocols: A Guide to Methods and Applications (Academic Press, New York); Innis and Gelfand, eds. (1995) PCR Strategies (Academic Press, New York); and Innis and Gelfand, eds. (1999) PCR Methods Manual (Academic Press, New York). Known methods of PCR include, but are not limited to, methods using paired primers, nested primers, single specific primers, degenerate primers, gene-specific primers, vector-specific primers, partially-mismatched primers, and the like.

The term "primer" as used herein refers to an oligonucleotide which is capable of annealing to the amplification target allowing a DNA polymerase to attach, thereby serving as a point of initiation of DNA synthesis when placed under conditions in which synthesis of primer extension product is induced, i.e., in the presence of nucleotides and an agent for polymerization such as DNA polymerase and at a suitable temperature and pH. The (amplification) primer is preferably single stranded for maximum efficiency in amplification. Preferably, the primer is an oligodeoxyribonucleotide. The primer must be sufficiently long to prime the synthesis of extension products in the presence of the agent for polymerization. The exact lengths of the primers will depend on many factors, including temperature and composition (A/T vs. G/C content) of primer. A pair of bi-directional primers consists of one forward and one reverse primer as commonly used in the art of DNA amplification such as in PCR amplification.

The terms "stringency" or "stringent hybridization conditions" refer to hybridization conditions that affect the stability of hybrids, e.g., temperature, salt concentration, pH, formamide concentration and the like. These conditions are empirically optimized to maximize specific binding and minimize non-specific binding of primer or probe to its target nucleic acid sequence. The terms as used include reference to conditions under which a probe or primer will hybridize to its target sequence, to a detectably greater degree than other sequences (e.g. at least 2-fold over background). Stringent conditions are sequence dependent and will be different in different circumstances. Longer sequences hybridize specifically at higher temperatures. Generally, stringent conditions are selected to be about 5° C. lower than the thermal melting point (Tm) for the specific sequence at a defined ionic strength and pH. The Tm is the temperature (under defined ionic strength and pH) at which 50% of a complementary target sequence hybridizes to a perfectly matched probe or primer. Typically, stringent conditions will be those in which the salt concentration is less than about 1.0 M Na+ ion, typically about 0.01 to 1.0 M Na+ ion concentration (or other salts) at pH 7.0 to 8.3 and the temperature is at least about 30° C. for short probes or primers (e.g. 10 to 50 nucleotides) and at least about 60° C. for long probes or primers (e.g. greater than 50 nucleotides). Stringent conditions may also be achieved with the addition of destabilizing agents such as formamide. Exemplary low stringent conditions or "conditions of reduced stringency" include hybridization with a buffer solution of 30% formamide, 1 M NaCl, 1% SDS at 37° C. and a wash in 2×SSC at 40° C. Exemplary high stringency conditions include hybridization in 50% formamide, 1M NaCl, 1% SDS at 37° C., and a wash in 0.1×SSC at 60° C. Hybridization procedures are well known in the art and are described by e.g. Ausubel et al., 1998 and Sambrook et al., 2001. In some embodiments, stringent conditions are hybridization in 0.25 M Na2HPO4 buffer (pH 7.2) containing 1 mM Na2EDTA, 0.5-20% sodium dodecyl sulfate at 45° C., such as 0.5%, 1%, 2%, 3%, 4%, 5%, 6%, 7%, 8%, 9%, 10%, 11%, 12%, 13%, 14%, 15%, 16%, 17%, 18%, 19% or 20%, followed by a wash in 5×SSC, containing 0.1% (w/v) sodium dodecyl sulfate, at 55° C. to 65° C.

As used herein, "promoter" refers to a DNA sequence capable of controlling the expression of a coding sequence or functional RNA. The promoter sequence consists of proximal and more distal upstream elements, the latter elements often referred to as enhancers. Accordingly, an "enhancer" is a DNA sequence that can stimulate promoter activity, and may be an innate element of the promoter or a heterologous element inserted to enhance the level or tissue specificity of a promoter. Promoters may be derived in their entirety from a native gene, or be composed of different elements derived from different promoters found in nature, or even comprise synthetic DNA segments. It is understood by those skilled in the art that different promoters may direct the expression of a gene in different tissues or cell types, or at different stages of development, or in response to different environmental conditions. It is further recognized that since in most cases the exact boundaries of regulatory sequences have not been completely defined, DNA fragments of some variation may have identical promoter activity.

As used herein, a "constitutive promoter" is a promoter which is active under most conditions and/or during most development stages. There are several advantages to using constitutive promoters in expression vectors used in biotechnology, such as: high level of production of proteins used to select transgenic cells or organisms; high level of expression of reporter proteins or scorable markers, allowing easy detection and quantification; high level of production of a transcription factor that is part of a regulatory transcription system; production of compounds that requires ubiquitous activity in the organism; and production of compounds that are required during all stages of development. Non-limiting exemplary constitutive promoters include, CaMV 35S promoter, opine promoters, ubiquitin promoter, alcohol dehydrogenase promoter, etc.

As used herein, a "non-constitutive promoter" is a promoter which is active under certain conditions, in certain types of cells, and/or during certain development stages. For example, tissue specific, tissue preferred, cell type specific, cell type preferred, inducible promoters, and promoters under development control are non-constitutive promoters. Examples of promoters under developmental control include promoters that preferentially initiate transcription in certain tissues.

As used herein, "inducible" or "repressible" promoter is a promoter which is under chemical or environmental factors control. Examples of environmental conditions that may affect transcription by inducible promoters include anaerobic conditions, certain chemicals, the presence of light, acidic or basic conditions, etc.

As used herein, a "tissue specific" promoter is a promoter that initiates transcription only in certain tissues. Unlike constitutive expression of genes, tissue-specific expression is the result of several interacting levels of gene regulation. As such, in the art sometimes it is preferable to use promoters from homologous or closely related species to achieve efficient and reliable expression of transgenes in particular tissues. This is one of the main reasons for the large amount of tissue-specific promoters isolated from particular tissues found in both scientific and patent literature.

As used herein, the term "operably linked" refers to the association of nucleic acid sequences on a single nucleic acid fragment so that the function of one is regulated by the other. For example, a promoter is operably linked with a coding sequence when it is capable of regulating the expression of that coding sequence (i.e., that the coding sequence is under the transcriptional control of the promoter). Coding sequences can be operably linked to regulatory sequences in a sense or antisense orientation. In another example, the complementary RNA regions of the disclosure can be operably linked, either directly or indirectly, 5' to the target mRNA, or 3' to the target mRNA, or within the target mRNA, or a first complementary region is 5' and its complement is 3' to the target mRNA.

As used herein, the phrases "recombinant construct", "expression construct", "chimeric construct", "construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such construct may be used by itself or may be used in conjunction with a vector. If a vector is used then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the disclosure. The skilled artisan will also recognize that different independent transformation events will result in different levels and patterns of expression (Jones et al., (1985) EMBO J. 4:2411-2418; De Almeida et al., (1989) Mol. Gen. Genetics 218:78-86), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others. Vectors can be plasmids, viruses, bacteriophages, pro-viruses, phagemids, transposons, artificial chromosomes, and the like, that replicate autonomously or can integrate into a chromosome of a host cell. A vector can also be a naked RNA polynucleotide, a naked DNA polynucleotide, a polynucleotide composed of both DNA and RNA within the same strand, a poly-lysine-conjugated DNA or RNA, a peptide-conjugated DNA or RNA, a liposome-conjugated DNA, or the like, that is not autonomously replicating. As used herein, the term "expression" refers to the production of a functional end-product e.g., an mRNA or a protein (precursor or mature).

In some embodiments, the cell or organism has at least one heterologous trait. As used herein, the term "heterologous trait" refers to a phenotype imparted to a transformed host cell or transgenic organism by an exogenous DNA segment, heterologous polynucleotide or heterologous nucleic acid. Various changes in phenotype are of interest to the present disclosure, including but not limited to modifying the fatty acid composition in milk, altering the carbohydrate content of milk, increasing an ungulate's yield of an economically important trait (e.g., milk, milk fat, milk proteins, etc.) and the like. These results can be achieved by providing expression of heterologous products or increased expression of endogenous products in organisms using the methods and compositions of the present disclosure.

As used herein, the term "MIC" means maximal information coefficient. MIC is a type of nonparamentric network analysis that identifies a score (MIC score) between active microbial strains of the present disclosure and at least one measured metadata (e.g., milk fat). Further, U.S. application Ser. No. 15/217,575, filed on Jul. 22, 2016 (issued as U.S. Pat. No. 9,540,676 on Jan. 10, 2017) is hereby incorporated by reference in its entirety.

Figure 17:
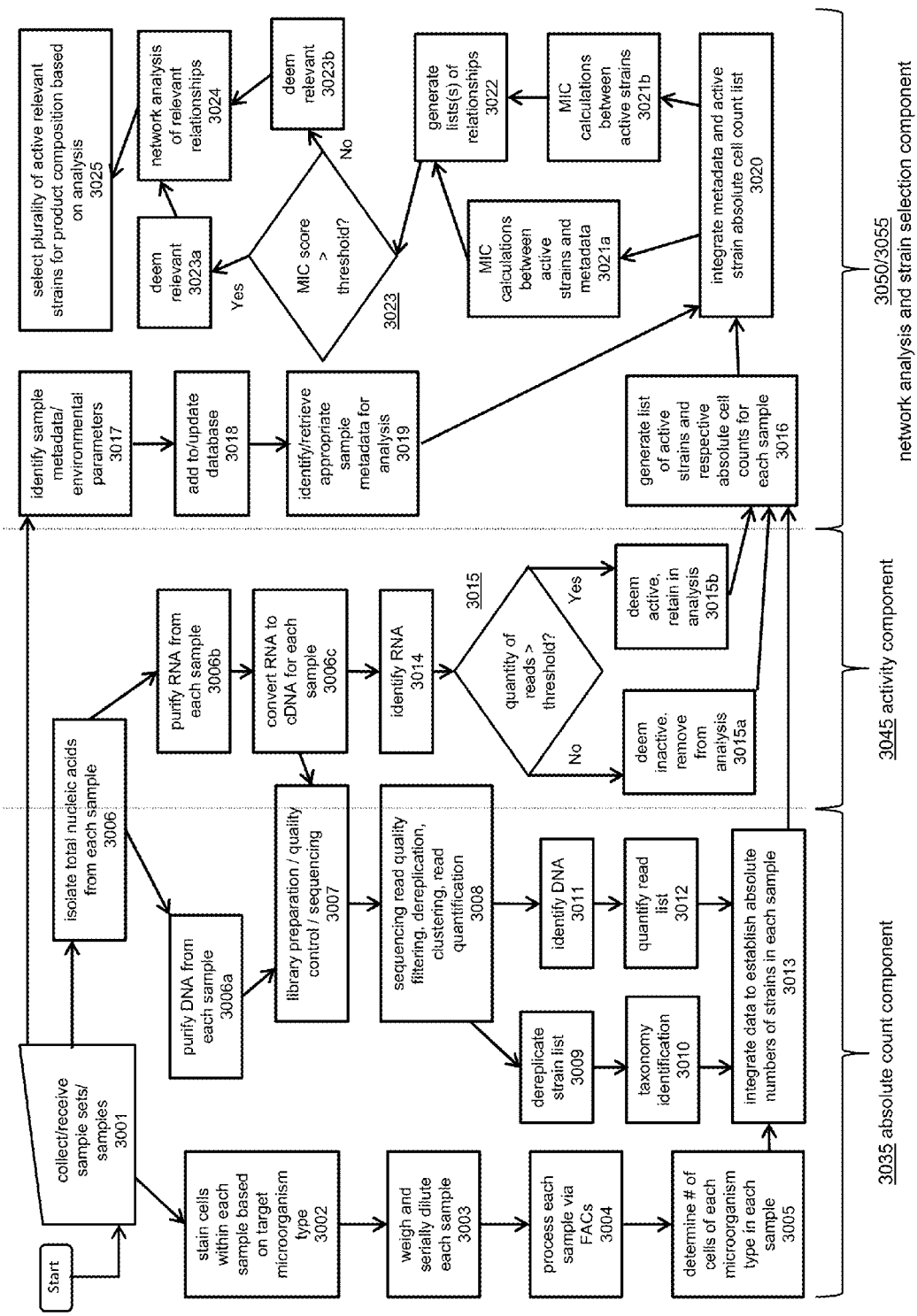
FIG. 17 depicts a schematic diagram that illustrates an example process flow for use with an exemplary microbe interaction analysis and selection system, including the determination of MIC scores discussed throughout the present disclosure.

The maximal information coefficient (MIC) is then calculated between strains and metadata 3021*a*, and between strains 3021*b*; as seen in FIG. 17. Results are pooled to create a list of all relationships and their corresponding MIC scores 3022. If the relationship scores below a given threshold 3023, the relationship is deemed/identified as irrelevant 3023b. If the relationship is above a given threshold 3023, the relationship deemed/identified as relevant 2023a, and is further subject to network analysis 3024. The following code fragment shows an exemplary methodology for such analysis, according to one embodiment:

```
Read total list of relationships file as links
    threshold = 0.8
    for i in range(len(links)):
        if links >= threshold
            multiplier[i] = 1
        else
            multiplier[i] = 0
    end if
    links_temp = multiplier*links
    final_links = links_temp[links_temp != 0]
    savetxt(output_file,final_links)
    output_file.close( )
```

Based on the output of the network analysis, active strains are selected 3025 for preparing products (e.g., ensembles, aggregates, and/or other synthetic groupings) containing the selected strains. The output of the network analysis can also be used to inform the selection of strains for further product composition testing.

The use of thresholds is discussed above for analyses and determinations. Thresholds can be, depending on the implementation and application: (1) empirically determined (e.g., based on distribution levels, setting a cutoff at a number that removes a specified or significant portion of low level reads); (2) any non-zero value; (3) percentage/percentile based; (4) only strains whose normalized second marker (i.e., activity) reads is greater than normalized first marker (cell count) reads; (5) log 2 fold change between activity and quantity or cell count; (6) normalized second marker (activity) reads is greater than mean second marker (activity) reads for entire sample (and/or sample set); and/or any magnitude threshold described above in addition to a statistical threshold (i.e., significance testing). The following example provides thresholding detail for distributions of RNA-based second marker measurements with respect to DNA-based first marker measurements, according to one embodiment.

As used herein "shelf-stable" refers to a functional attribute and new utility acquired by the microbes formulated according to the disclosure, which enable said microbes to exist in a useful/active state outside of their natural environment in the rumen (i.e. a markedly different characteristic). Thus, shelf-stable is a functional attribute created by the formulations/compositions of the disclosure and denoting that the microbe formulated into a shelf-stable composition can exist outside the rumen and under ambient conditions for a period of time that can be determined depending upon the particular formulation utilized, but in general means that the microbes can be formulated to exist in a composition that is stable under ambient conditions for at least a few days and generally at least one week. Accordingly, a "shelf-stable ruminant supplement" is a composition comprising one or more microbes of the disclosure, said microbes formulated in a composition, such that the composition is stable under ambient conditions for at least one week, meaning that the microbes comprised in the composition (e.g. whole cell, spore, or lysed cell) are able to impart one or more beneficial phenotypic properties to a ruminant when administered (e.g. increased milk yield, improved milk compositional characteristics, improved rumen health, and/or modulation of the rumen microbiome).

Isolated Microbes

In some aspects, the present disclosure provides isolated microbes, including novel strains of microbes, presented in Table 1 and Table 3.

In other aspects, the present disclosure provides isolated whole microbial cultures of the microbes identified in Table 1 and Table 3. These cultures may comprise microbes at various concentrations.

In some aspects, the disclosure provides for utilizing one or more microbes selected from Table 1 and Table 3 to increase a phenotypic trait of interest in a ruminant.

In some embodiments, the disclosure provides isolated microbial species belonging to taxonomic families of Clostridiaceae, Ruminococcaceae, Lachnospiraceae, Acidaminococcaceae, Peptococcaceae, Porphyromonadaceae, Prevotellaceae, Neocallimastigaceae, Saccharomycetaceae, Phaeosphaeriaceae, Erysipelotrichia, Anaerolinaeceae, Atopobiaceae, Botryosphaeriaceae, Eubacteriaceae, Acholeplasmataceae, Succinivibrionaceae, Lactobacillaceae, Selenomonadaceae, Burkholderiaceae, and Streptococcaceae.

In further embodiments, isolated microbial species may be selected from genera of family Clostridiaceae, including *Acetanaerobacterium, Acetivibrio, Acidaminobacter, Alkahphilus, Anaerobacter, Anaerostipes, Anaerotruncus, Anoxynatronum, Bryantella, Butyricicoccus, Caldanaerocella, Caloramator, Caloranaerobacter, Caminicella, Candidatus Arthromitus, Clostridium, Coprobacillus, Dorea, Ethanologenbacterium, Faecalibacterium, Garciella, Guggenheimella, Hespellia, Linmingia, Natronincola, Oxobacter, Parasporobacterium, Sarcina, Soehngenia, Sporobacter, Subdoligranulum, Tepidibacter, Tepidimicrobium, Thermobrachium, Thermohalobacter*, and *Tindallia*.

In further embodiments, isolated microbial species may be selected from genera of family Ruminococcaceae, including *Ruminococcus, Acetivibrio, Sporobacter, Anaerofilium, Papillibacter, Oscillospira, Gemmiger, Faecalibacterium, Fastidiosipila, Anaerotruncus, Ethanolingenens, Acetanaerobacterium, Subdoligranulum, Hydrogenoanaerobacterium*, and *Candidadus Soleaferrea*.

In further embodiments, isolated microbial species may be selected from genera of family Lachnospiraceae, including *Butyrivibrio, Roseburia, Lachnospira, Acetitomaculum, Coprococcus, Johnsonella, Catonella, Pseudobutyrivibrio, Syntrophococcus, Sporobacterium, Parasporobacterium, Lachnobacterium, Shuttleworthia, Dorea, Anaerostipes, Hespellia, Marvinbryantia, Oribacterium, Moryella, Blautia, Robinsoniella, Cellulosilyticum, Lachnoanaerobaculum, Stomatobaculum, Fusicatenibacter, Acetatifactor*, and *Eisenbergiella*.

In further embodiments, isolated microbial species may be selected from genera of family Acidaminococcaceae, including *Acidaminococcus, Phascolarctobacterium, Succiniclasticum*, and *Succinispira*.

In further embodiments, isolated microbial species may be selected from genera of family Peptococcaceae, including

*Desulfotomaculum, Peptococcus, Desulfitobacterium, Syntrophobotulus, Dehalobacter, Sporotomaculum, Desulfosporosinus, Desulfonispora, Pelotomaculum, Thermincola, Cryptanaerobacter, Desulfitibacter, Candidatus Desulforudis, Desulfurispora,* and *Desulfitospora.*

In further embodiments, isolated microbial species may be selected from genera of family Porphyromonadaceae, including *Porphyromonas, Dysgonomonas, Tannerella, Odoribacter, Proteimphilum, Petrimonas, Paludibacter, Parabacteroides, Barnesiella, Candidatus Vestibaculum, Butyricimonas, Macellibacteroides,* and *Coprobacter.*

In further embodiments, isolated microbial species may be selected from genera of family Anaerolinaeceae including *Anaerolinea, Bellilinea, Leptolinea, Levilinea, Longilinea, Ornatilinea,* and *Pelolinea.*

In further embodiments, isolated microbial species may be selected from genera of family Atopobiaceae including *Atopbium* and *Olsenella.*

In further embodiments, isolated microbial species may be selected from genera of family Eubacteriaceae including *Acetobacterium, Alkalibacter, Alkalibaculum, Aminicella, Anaerofustis, Eubacterium, Gardella,* and *Pseudoramibacter.*

In further embodiments, isolated microbial species may be selected from genera of family Acholeplasmataceae including *Acholeplasma.*

In further embodiments, isolated microbial species may be selected from genera of family Succinivibrionaceae including *Anaerobiospirillum, Ruminobacter, Succinatimonas, Succinimonas,* and *Succinivibrio.*

In further embodiments, isolated microbial species may be selected from genera of family Lactobacillaceae including *Lactobacillus, Paralactobacillus, Pediococcus,* and *Sharpea.*

In further embodiments, isolated microbial species may be selected from genera of family Selenomonadaceae including *Anaerovibrio, Centipeda, Megamonas, Mitsuokella, Pectinatus, Propionispira, Schwartzia, Selenomonas,* and *Zymophilus.*

In further embodiments, isolated microbial species may be selected from genera of family Burkholderiaceae including *Burkholderia, Chitinimonas, Cupriavidus, Lautropia, Limnobacter, Pandoraea, Paraburkholderia, Paucimonas, Polynucleobacter, Ralstonia, Thermothrix,* and *Wautersia.*

In further embodiments, isolated microbial species may be selected from genera of family Streptococcaceae including *Lactococcus, Lactovum,* and *Streptococcus.*

In further embodiments, isolated microbial species may be selected from genera of family Anaerolinaeceae including *Aestuariimicrobium, Arachnia, Auraticoccus, Brooklawnia, Friedmanniella, Granulicoccus, Luteococcus, Mariniluteicoccus, Microlunatus, Micropruina, Naumannella, Propionibacterium, Propionicicella, Propioniciclava, Propioniferax, Propionimicrobium,* and *Tessaracoccus.*

In further embodiments, isolated microbial species may be selected from genera of family Prevotellaceae, including *Paraprevotella, Prevotella, hallella, Xylanibacter,* and *Alloprevotella.*

In further embodiments, isolated microbial species may be selected from genera of family Neocallimastigaceae, including *Anaeromyces, Caecomyces, Cyllamyces, Neocallimastix, Orpinomyces,* and *Piromyces.*

In further embodiments, isolated microbial species may be selected from genera of family Saccharomycetaceae, including *Brettanomyces, Candida, Citeromyces, Cyniclomyces, Debaryomyces, Issatchenkia, Kazachstania* (syn. *Arxiozyma*), *Kluyveromyces, Komagataella, Kuraishia, Lachancea, Lodderomyces, Nakaseomyces, Pachysolen, Pichia, Saccharomyces, Spathaspora, Tetrapisispora, Vanderwaltozyma, Torulaspora, Williopsis, Zygosaccharomyces,* and *Zygotorulaspora.*

In further embodiments, isolated microbial species may be selected from genera of family Erysipelotrichaceae, including *Erysipelothrix, Solobacterium, Turicibacter, Faecalibaculum, Faecalicoccus, Faecalitalea, Holdemanella, Holdemania, Dielma, Eggerthia, Erysipelatoclostridium, Allobacterium, Breznakia, Bulleidia, Catenibacterium, Catenisphaera,* and *Coprobacillus.*

In further embodiments, isolated microbial species may be selected from genera of family Phaeosphaeriaceae, including *Barria, Bricookea, Carinispora, Chaetoplea, Eudarluca, Hadrospora, Isthmosporella, Katumotoa, Lautitia, Metameris, Mixtura, Neophaeosphaeria, Nodulosphaeria, Ophiosphaerella, Phaeosphaeris, Phaeosphaeriopsis, Setomelanomma, Stagonospora, Teratosphaeria,* and *Wilmia.*

In further embodiments, isolated microbial species may be selected from genera of family Botryosphaeriaceae, including *Amarenomyces, Aplosporella, Auerswaldiella, Botryosphaeria, Dichomera, Diplodia, Discochora, Dothidothia, Dothiorella, Fusicoccum, Granulodiplodia, Guignardia, Lasiodiplodia, Leptodothiorella, Leptodothiorella, Leptoguignardia, Macrophoma, Macrophomina, Nattrassia, Neodeightonia, Neofusicocum, Neoscytalidium, Otthia, Phaeobotryosphaeria, Phomatosphaeropsis, Phyllosticta, Pseudofusicoccum, Saccharata, Sivanesania,* and *Thyrostroma.*

In some embodiments, the disclosure provides isolated microbial species belonging to genera of: *Clostridium, Ruminococcus, Roseburia, Hydrogenoanaerobacterium, Saccharofermentans, Papillibacter, Pelotomaculum, Butyricicoccus, Tannerella, Prevotella, Butyricimonas, Piromyces, Candida, Vrystaatia, Orpinomyces, Neocallimastix,* and *Phyllosticta.* In further embodiments, the disclosure provides isolated microbial species belonging to the family of Lachnospiraceae, and the order of Saccharomycetales. In further embodiments, the disclosure provides isolated microbial species of *Candida xylopsoci, Vrystaatia aloeicola,* and *Phyllosticta capitalensis.*

In some embodiments, a microbe from the taxa disclosed herein are utilized to impart one or more beneficial properties or improved traits to milk in ruminants.

In some embodiments, the disclosure provides isolated microbial species, selected from the group consisting of: *Clostridium, Ruminococcus, Roseburia, Hydrogenoanaerobacterium, Saccharofermentans, Papillibacter, Pelotomaculum, Butyricicoccus, Tannerella, Prevotella, Butyricimonas, Piromyces, Pichia, Candida, Vrystaatia, Orpinomyces, Neocallimastix,* and *Phyllosticta.*

In some embodiments, the disclosure provides novel isolated microbial strains of species, selected from the group consisting of: *Clostridium, Ruminococcus, Roseburia, Hydrogenoanaerobacterium, Saccharofermentans, Papillibacter, Pelotomaculum, Butyricicoccus, Tannerella, Prevotella, Butyricimonas, Piromyces, Pichia, Candida, Vrystaatia, Orpinomyces, Neocallimastix,* and *Phyllosticta*. Particular novel strains of these aforementioned taxonomic groups can be found in Table 1 and/or Table 3.

Furthermore, the disclosure relates to microbes having characteristics substantially similar to that of a microbe identified in Table 1 or Table 3.

The isolated microbial species, and novel strains of said species, identified in the present disclosure, are able to impart beneficial properties or traits to ruminant milk production.

For instance, the isolated microbes described in Table 1 and Table 3, or consortia of said microbes, are able to increase total milk fat in ruminant milk. The increase can be quantitatively measured, for example, by measuring the effect that said microbial application has upon the modulation of total milk fat.

In some embodiments, the isolated microbial strains are microbes of the present disclosure that have been genetically modified. In some embodiments, the genetically modified or recombinant microbes comprise polynucleotide sequences which do not naturally occur in said microbes. In some embodiments, the microbes may comprise heterologous polynucleotides. In further embodiments, the heterologous polynucleotides may be operably linked to one or more polynucleotides native to the microbes.

In some embodiments, the heterologous polynucleotides may be reporter genes or selectable markers. In some embodiments, reporter genes may be selected from any of the family of fluorescence proteins (e.g., GFP, RFP, YFP, and the like), β-galactosidase, luciferase. In some embodiments, selectable markers may be selected from neomycin phosphotransferase, hygromycin phosphotransferase, aminoglycoside adenyltransferase, dihydrofolate reductase, acetolactase synthase, bromoxynil nitrilase, β-glucuronidase, dihydrogolate reductase, and chloramphenicol acetyltransferase. In some embodiments, the heterologous polynucleotide may be operably linked to one or more promoter.

TABLE 4

Taxa (largely Genera) of the present disclosure not known to have been utilized in animal agriculture.

| | |
|---|---|
| Intestinimonas | Anaerolinea |
| Pseudobutyrivibrio | Olsenella |
| Eubacterium | Catenisphaera |
| Faecalibacterium | Solobacterium |
| Blautia | Ralsonia |
| Coprococcus | Casaltella |
| Anaeroplasma | Acholeplasma |
| Aminiphilus | Mitsuokella |
| Alistipes | Sharpea |
| Oscillibacter | Neocallimastix |
| Odoribacter | Pichia |
| Tannerella | Candida |
| Hydrogenoanaerobacterium | Orpinomyces |
| Succinivibrio | Sugiyamaella |
| Ruminobacter | Cyllamyces |
| Lachnospira | Caecomyces |
| Sinimarinibacterium | Tremella |
| Hydrogenoanaerobacterium | Turicibacter |
| Clostridium XIVa | Anaerolinea |

TABLE 4-continued

Taxa (largely Genera) of the present disclosure not known to have been utilized in animal agriculture.

| | |
|---|---|
| Saccharofermentans | Piromyces |
| Butyricicoccus | Olsenella |
| Papillibacter | Clostridium XICa |
| Pelotomaculum | Erysipelotrichaceae |
| Lachnospiracea | Solobacterium |
| Anaeroplasma | Ralstonia |
| Clostridium | Eubacterium |
| Rikenella | Lachnobacterium |
| Tannerella | Acholeplasma |
| Howardella | Selenomonas |
| Butyricimonas | Sharpea |
| Succinivibrio | Phyllosticta |
| Ruminobacter | Candida xylopsoc |
| Syntrophococcus | Candida apicol |
| Pseudobutyrivibrio | Saccharomycetales |
| Ascomycota | Candida rugos |

Microbial Consortia

In some aspects, the disclosure provides microbial consortia comprising a combination of at least any two microbes selected from amongst the microbes identified in Table 1 and/or Table 3.

In certain embodiments, the consortia of the present disclosure comprise two microbes, or three microbes, or four microbes, or five microbes, or six microbes, or seven microbes, or eight microbes, or nine microbes, or ten or more microbes. Said microbes of the consortia are different microbial species, or different strains of a microbial species.

In some embodiments, the disclosure provides consortia, comprising: at least two isolated microbial species belonging to genera of: *Clostridium, Ruminococcus, Roseburia, Hydrogenoanaerobacterium, Saccharofermentans, Papillibacter, Pelotomaculum, Butyricicoccus, Tannerella, Prevotella, Butyricimonas, Piromyces, Pichia, Candida, Vrystaatia, Orpinomyces, Neocallimastix,* and *Phyllosticta*. Particular novel strains of species of these aforementioned genera can be found in Table 1 and/or Table 3.

In some embodiments, the disclosure provides consortia, comprising: at least two isolated microbial species, selected from the group consisting of species of the family of Lachnospiraceae, and the order of Saccharomycetales.

In particular aspects, the disclosure provides microbial consortia, comprising species as grouped in Tables 5-11. With respect to Tables 5-11, the letters A through I represent a non-limiting selection of microbes of the present disclosure, defined as:

A=Strain designation Ascusb_7 identified in Table 1;

B=Strain designation Ascusb_3138 identified in Table 1;

C=Strain designation Ascusb_82 identified in Table 1;

D=Strain designation Ascusb_119 identified in Table 1;

E=Strain designation Ascusb_1801 identified in Table 1;

F=Strain designation Ascusf_23 identified in Table 1;

G=Strain designation Ascusf_24 identified in Table 1;

H=Strain designation Ascusf_45 identified in Table 1; and

I=Strain designation Ascusf_15 identified in Table 1.

TABLE 5

Eight and Nine Strain Consortia

| | | | | | |
|---|---|---|---|---|---|
| A, B, C, D, E, F, G, H | A, B, C, D, E, F, G, I | A, B, C, D, E, F, H, I | A, B, C, D, E, G, H, I | A, B, C, D, F, G, H, I | A, B, C, E, F, G, H, I |
| A, B, D, E, F, G, H, I | A, C, D, E, F, G, H, I | B, C, D, E, F, G, H, I | A, B, C, D, E, F, G, H, I | | |

TABLE 6

Seven Strain Consortia

| | | | | | |
|---|---|---|---|---|---|
| A, B, C, D, E, F, G | A, B, C, D, E, F, H | A, B, C, D, E, F, I | A, B, C, D, E, G, H | A, B, C, D, E, G, I | A, B, C, D, E, H, I |
| A, B, C, D, F, G, H | A, B, C, D, F, G, I | A, B, C, D, F, H, I | A, B, C, D, G, H, I | A, B, C, E, F, G, H | A, B, C, E, F, G, I |
| A, B, C, E, F, H, I | A, B, C, E, G, H, I | A, B, C, F, G, H, I | A, B, D, E, F, G, H | A, B, D, E, F, G, I | A, B, D, E, F, H, I |
| A, B, D, E, G, H, I | A, B, D, F, G, H, I | A, B, E, F, G, H, I | A, C, D, E, F, G, H | A, C, D, E, F, G, I | A, C, D, E, F, H, I |
| A, C, D, E, G, H, I | A, C, D, F, G, H, I | A, C, E, F, G, H, I | A, D, E, F, G, H, I | B, C, D, E, F, G, H | B, C, D, E, F, G, I |
| B, C, D, E, F, H, I | B, C, D, E, G, H, I | B, C, D, F, G, H, I | B, C, E, F, G, H, I | B, D, E, F, G, H, I | C, D, E, F, G, H, I |

TABLE 7

Six Strain Consortia

| | | | | | | |
|---|---|---|---|---|---|---|
| A, B, C, D, E, F | A, B, C, D, E, G | A, B, C, D, E, H | A, B, C, D, E, I | A, B, C, D, F, G | A, B, C, D, F, H | A, B, C, D, F, I |
| A, B, C, D, G, H | A, B, C, D, G, I | A, B, C, D, H, I | A, B, C, E, F, G | A, B, C, E, F, H | A, B, C, E, F, I | A, B, C, E, G, H |
| A, B, C, E, G, I | A, B, C, E, H, I | A, B, C, F, G, H | A, B, C, F, G, I | A, B, C, F, H, I | A, B, C, G, H, I | A, B, D, E, F, G |
| A, B, D, E, F, H | A, B, D, E, F, I | A, B, D, E, G, H | A, B, D, E, G, I | A, B, D, E, H, I | A, B, D, F, G, H | A, B, D, F, G, I |
| D, E, F, G, H, I | C, E, F, G, H, I | A, B, D, F, H, I | A, B, D, G, H, I | A, B, E, F, G, H | A, B, E, F, G, I | A, B, E, F, H, I |
| A, B, E, G, H, I | A, B, F, G, H, I | A, C, D, E, F, G | A, C, D, E, F, H | A, C, D, E, F, I | A, C, D, E, G, H | A, C, D, E, G, I |
| A, C, D, E, H, I | A, C, D, F, G, H | A, C, D, F, G, I | A, C, D, F, H, I | A, C, D, G, H, I | A, C, E, F, G, H | A, C, E, F, G, I |
| A, C, E, F, H, I | A, C, E, G, H, I | A, C, F, G, H, I | A, D, E, F, G, H | A, D, E, F, G, I | A, D, E, F, H, I | A, D, E, G, H, I |
| A, D, F, G, H, I | A, E, F, G, H, I | B, C, D, E, F, G | B, C, D, E, F, H | B, C, D, E, F, I | B, C, D, E, G, H | B, C, D, E, G, I |
| B, C, D, E, H, I | B, C, D, F, G, H | B, C, D, F, G, I | B, C, D, F, H, I | B, C, D, G, H, I | B, C, E, F, G, H | B, C, E, F, G, I |
| B, C, E, F, H, I | B, C, E, G, H, I | B, C, F, G, H, I | B, D, E, F, G, H | B, D, E, F, G, I | B, D, E, F, H, I | B, D, E, G, H, I |
| B, D, F, G, H, I | B, E, F, G, H, I | C, D, E, F, G, H | C, D, E, F, G, I | C, D, E, F, H, I | C, D, E, G, H, I | C, D, F, G, H, I |

TABLE 8

Five Strain Consortia

| | | | | | | | |
|---|---|---|---|---|---|---|---|
| A, B, C, D, E | A, B, C, D, F | A, B, C, D, G | A, B, C, D, H | A, B, C, D, I | A, B, C, E, F | A, B, C, E, G | A, B, C, E, H |
| A, B, C, F, H | A, B, C, F, G | A, B, C, F, I | A, B, C, G, H | A, B, C, G, I | A, B, C, H, I | A, B, D, E, F | A, B, D, E, G |
| A, B, D, E, I | A, B, D, F, G | A, B, D, F, H | A, B, D, F, I | A, B, D, G, H | A, B, D, G, I | A, B, D, H, I | A, B, E, F, G |
| A, B, E, F, I | A, B, E, G, H | A, B, E, G, I | A, B, E, H, I | A, B, F, G, H | A, B, F, G, I | A, B, F, H, I | A, B, G, H, I |
| A, C, D, E, G | A, C, D, E, H | A, C, D, E, I | A, C, D, F, G | A, C, D, F, H | A, C, D, E, F, I | A, C, D, G, H | A, C, D, G, I |
| A, C, E, F, G | A, C, E, F, H | A, C, E, F, I | A, C, E, G, H | A, C, E, G, I | A, C, E, H, I | A, C, F, G, H | A, C, F, G, I |
| A, C, G, H, I | A, D, E, F, G | A, D, E, F, H | A, D, E, F, I | A, D, E, G, H | A, D, E, G, I | A, D, E, H, I | A, D, F, G, H |
| A, D, F, H, I | A, D, G, H, I | A, E, F, G, H | A, E, F, G, I | A, E, F, H, I | A, E, G, H, I | A, F, G, H, I | B, C, D, E, F |
| B, C, D, E, H | B, C, D, E, I | B, C, D, F, G | B, C, D, F, H | B, C, D, F, I | B, C, D, G, H | B, C, D, G, I | B, C, D, H, I |
| B, C, E, F, H | B, C, E, F, I | B, C, E, G, H | B, C, E, G, I | B, C, E, H, I | B, C, F, G, H | B, C, F, G, I | B, C, F, H, I |
| B, D, E, F, G | B, D, E, F, H | B, D, E, F, I | B, D, E, G, H | B, D, E, G, I | B, D, E, H, I | B, D, F, G, H | B, D, F, G, I |
| B, D, G, H, I | B, E, F, G, H | B, E, F, G, I | B, E, F, H, I | B, E, G, H, I | B, F, G, H, I | C, D, E, F, G | C, D, E, F, H |
| C, D, E, G, H | C, D, E, G, I | C, D, E, H, I | C, D, F, G, H | C, D, F, G, I | C, D, F, H, I | C, E, F, G, H | C, E, F, G, I |
| C, E, F, H, I | C, E, G, H, I | C, F, G, H, I | D, E, F, G, H | D, E, F, G, I | D, E, F, H, I | D, E, G, H, I | D, F, G, H, I |
| A, B, C, E, I | A, B, D, E, H | A, B, E, F, H | A, C, D, E, F | A, C, D, H, I | A, C, F, H, I | A, D, F, G, I | B, C, D, E, G |
| B, C, E, F, G | B, C, G, H, I | B, D, F, H, I | C, D, E, F, I | C, E, F, G, I | E, F, G, H, I | | |

TABLE 9

Four Strain Consortia

| | | | | | | | |
|---|---|---|---|---|---|---|---|
| A, B, C, D | A, B, C, E | A, B, C, F | A, B, C, G | A, B, C, H | A, B, C, I | A, B, D, E | A, B, D, F |
| A, B, D, G | A, B, D, H | A, B, D, I | A, B, E, F | A, B, E, G | A, B, E, H | A, B, E, I | A, B, F, G |
| A, B, F, H | A, D, F, H | A, D, F, I | A, D, G, H | A, D, G, I | A, E, F, G | A, E, F, H | E, F, G, I |
| A, B, F, I | A, B, G, H | A, B, G, I | A, B, H, I | A, C, D, E | A, C, D, F | A, C, D, G | A, C, D, H |
| A, C, D, I | A, C, E, F | A, C, E, G | A, C, E, H | A, C, E, I | A, C, F, G | A, C, F, H | A, C, F, I |
| A, C, G, H | A, C, G, I | A, C, H, I | A, D, E, F | A, D, E, G | A, D, E, H | A, D, E, I | A, D, F, G |
| A, E, F, I | A, E, G, H | A, E, G, I | A, E, H, I | A, F, G, H | A, F, G, I | A, F, H, I | A, G, H, I |
| B, C, D, E | B, C, D, F | B, C, D, G | B, C, D, H | B, C, D, I | B, C, E, F | B, C, E, G | B, C, E, H |
| B, C, E, I | B, C, F, G | B, C, F, H | B, C, F, I | B, C, G, H | B, C, G, I | B, C, H, I | B, D, E, F |
| B, D, E, G | B, D, E, H | B, D, E, I | B, D, F, G | B, D, F, H | B, D, F, I | B, D, G, H | B, D, G, I |
| B, D, H, I | B, E, F, G | B, E, F, H | B, E, F, I | B, E, G, H | B, E, G, I | B, E, H, I | B, F, G, H |
| B, F, G, I | B, F, H, I | B, G, H, I | C, D, E, F | C, D, E, G | C, D, E, H | C, D, E, I | C, D, F, G |
| E, F, G, H | F, G, H, I | D, E, F, H | E, G, H, I | F, G, H, I | D, E, F, H | D, E, G, H | D, F, G, H |

TABLE 9-continued

Four Strain Consortia

| | | | | | | | | |
|---|---|---|---|---|---|---|---|---|
| C, D, F, H | C, D, F, I | C, D, G, H | C, D, G, I | C, D, H, I | C, E, F, G | C, E, F, H | C, E, F, I | D, F, G, I |
| C, E, G, H | C, E, G, I | C, E, H, I | C, F, G, H | C, F, G, I | C, F, H, I | C, G, H, I | D, E, F, G | D, F, H, I |

TABLE 10

Three Strain Consortia

| | | | | | | | | | |
|---|---|---|---|---|---|---|---|---|---|
| A, B, C | A, B, D | A, B, E | A, B, F | A, B, G | A, B, H | A, B, I | A, C, D | A, C, E | G, H, I | E, F, H |
| A, C, F | A, C, G | A, C, H | A, C, I | A, D, E | A, D, F | A, D, G | A, D, H | A, D, I | F, H, I | E, F, G |
| A, E, F | A, E, G | A, E, H | A, E, I | A, F, G | A, F, H | A, F, I | A, G, H | A, G, I | F, G, I | D, H, I |
| A, H, I | B, C, D | B, C, E | B, C, F | B, C, G | B, C, H | B, C, I | B, D, E | B, D, F | F, G, H | D, G, I |
| B, D, G | B, D, H | B, D, I | B, E, F | B, E, G | B, E, H | B, E, I | B, F, G | B, F, H | E, H, I | E, F, I |
| B, F, I | B, G, H | B, G, I | B, H, I | C, D, E | C, D, F | C, D, G | C, D, H | C, D, I | E, G, I | D, G, H |
| C, E, F | C, E, G | C, E, H | C, E, I | C, F, G | C, F, H | C, F, I | C, G, H | C, G, I | E, G, H | D, F, I |
| C, H, I | D, E, F | D, E, G | D, E, H | D, E, I | D, F, G | D, F, H | | | | |

TABLE 11

Two Strain Consortia

| | | | | | | | | | | | | | | | | |
|---|---|---|---|---|---|---|---|---|---|---|---|---|---|---|---|---|
| A, B | A, C | A, D | A, E | A, F | A, G | A, H | A, I | B, C | B, D | B, E | B, F | B, G | B, H | B, I | C, D |
| C, E | C, F | C, G | C, H | C, I | D, E | D, F | D, G | D, H | D, I | E, F | E, G | E, H | E, I | F, G | F, H |
| F, I | G, H | G, I | H, I | | | | | | | | | | | | |

In some embodiments, the microbial consortia may be selected from any member group from Tables 5-11.

Isolated Microbes—Source Material

The microbes of the present disclosure were obtained, among other places, at various locales in the United States from the gastrointestinal tract of cows.

Isolated Microbes—Microbial Culture Techniques

The microbes of Table 1 and Table 3 were matched to their nearest taxonomic groups by utilizing classification tools of the Ribosomal Database Project (RDP) for 16s rRNA sequences and the User-friendly Nordic ITS Ectomycorrhiza (UNITE) database for ITS rRNA sequences. Examples of matching microbes to their nearest taxa may be found in Lan et al. (2012. *PLOS one.* 7(3):e32491), Schloss and Westcott (2011. *Appl. Environ. Microbiol.* 77(10):3219-3226), and Koljalg et al. (2005. *New Phytologist.* 166(3): 1063-1068).

The isolation, identification, and culturing of the microbes of the present disclosure can be effected using standard microbiological techniques. Examples of such techniques may be found in Gerhardt, P. (ed.) Methods for General and Molecular Microbiology. American Society for Microbiology, Washington, D.C. (1994) and Lennette, E. H. (ed.) Manual of Clinical Microbiology, Third Edition. American Society for Microbiology, Washington, D.C. (1980), each of which is incorporated by reference.

Isolation can be effected by streaking the specimen on a solid medium (e.g., nutrient agar plates) to obtain a single colony, which is characterized by the phenotypic traits described hereinabove (e.g., Gram positive/negative, capable of forming spores aerobically/anaerobically, cellular morphology, carbon source metabolism, acid/base production, enzyme secretion, metabolic secretions, etc.) and to reduce the likelihood of working with a culture which has become contaminated.

For example, for microbes of the disclosure, biologically pure isolates can be obtained through repeated subculture of biological samples, each subculture followed by streaking onto solid media to obtain individual colonies or colony forming units. Methods of preparing, thawing, and growing lyophilized bacteria are commonly known, for example, Gherna, R. L. and C. A. Reddy. 2007. Culture Preservation, p 1019-1033. In C. A. Reddy, T. J. Beveridge, J. A. Breznak, G. A. Marzluf, T. M. Schmidt, and L. R. Snyder, eds. American Society for Microbiology, Washington, D.C., 1033 pages; herein incorporated by reference. Thus freeze dried liquid formulations and cultures stored long term at −70° C. in solutions containing glycerol are contemplated for use in providing formulations of the present disclosure.

The microbes of the disclosure can be propagated in a liquid medium under aerobic conditions, or alternatively anaerobic conditions. Medium for growing the bacterial strains of the present disclosure includes a carbon source, a nitrogen source, and inorganic salts, as well as specially required substances such as vitamins, amino acids, nucleic acids and the like. Examples of suitable carbon sources which can be used for growing the microbes include, but are not limited to, starch, peptone, yeast extract, amino acids, sugars such as glucose, arabinose, mannose, glucosamine, maltose, and the like; salts of organic acids such as acetic acid, fumaric acid, adipic acid, propionic acid, citric acid, gluconic acid, malic acid, pyruvic acid, malonic acid and the like; alcohols such as ethanol and glycerol and the like; oil or fat such as soybean oil, rice bran oil, olive oil, corn oil, sesame oil. The amount of the carbon source added varies according to the kind of carbon source and is typically between 1 to 100 gram(s) per liter of medium. Preferably, glucose, starch, and/or peptone is contained in the medium as a major carbon source, at a concentration of 0.1-5% (W/V). Examples of suitable nitrogen sources which can be used for growing the bacterial strains of the present disclosure include, but are not limited to, amino acids, yeast extract, tryptone, beef extract, peptone, potassium nitrate, ammonium nitrate, ammonium chloride, ammonium sulfate, ammonium phosphate, ammonia or combinations thereof. The amount of nitrogen source varies according to the type of nitrogen source, typically between 0.1 to 30 gram per liter of medium. The inorganic salts, potassium dihydrogen phosphate, dipotassium hydrogen phosphate, disodium hydrogen phosphate, magnesium sulfate, magnesium chloride, ferric sulfate, ferrous sulfate, ferric chloride, ferrous chloride, manganous sulfate, manganous chloride, zinc sulfate, zinc chloride, cupric sulfate, calcium chloride, sodium chloride, calcium carbonate, sodium carbonate can be used alone or in combination. The amount of inorganic acid varies according to the kind of the inorganic salt, typically between 0.001 to 10 gram per liter of medium. Examples of specially required substances include, but are not limited to, vitamins, nucleic acids, yeast extract, peptone, meat extract, malt extract, dried yeast and combinations thereof. Cultivation can be effected at a temperature, which allows the growth of the microbial strains, essentially, between 20° C. and 46° C. In some aspects, a temperature range is 30° C.-39° C. For optimal growth, in some embodiments, the medium can be adjusted to pH 6.0-7.4. It will be appreciated that commercially available media may also be used to culture the microbial strains, such as Nutrient Broth or Nutrient Agar available from Difco, Detroit, Mich. It will be appreciated that cultivation time may differ depending on the type of culture medium used and the concentration of sugar as a major carbon source.

In some aspects, cultivation lasts between 24-96 hours. Microbial cells thus obtained are isolated using methods, which are well known in the art. Examples include, but are not limited to, membrane filtration and centrifugal separation. The pH may be adjusted using sodium hydroxide and the like and the culture may be dried using a freeze dryer, until the water content becomes equal to 4% or less. Microbial co-cultures may be obtained by propagating each strain as described hereinabove. In some aspects, microbial multi-strain cultures may be obtained by propagating two or more of the strains described hereinabove. It will be appreciated that the microbial strains may be cultured together when compatible culture conditions can be employed.

Isolated Microbes—Microbial Strains

Microbes can be distinguished into a genus based on polyphasic taxonomy, which incorporates all available phenotypic and genotypic data into a consensus classification (Vandamme et al. 1996. Polyphasic taxonomy, a consensus approach to bacterial systematics. *Microbial Rev* 1996, 60:407-438). One accepted genotypic method for defining species is based on overall genomic relatedness, such that strains which share approximately 70% or more relatedness using DNA-DNA hybridization, with 5° C. or less $\Delta T_m$ (the difference in the melting temperature between homologous and heterologous hybrids), under standard conditions, are considered to be members of the same species. Thus, populations that share greater than the aforementioned 70% threshold can be considered to be variants of the same species. Another accepted genotypic method for defining species is to isolate marker genes of the present disclosure, sequence these genes, and align these sequenced genes from multiple isolates or variants. The microbes are interpreted as belonging to the same species if one or more of the sequenced genes share at least 97% sequence identity.

The 16S or 18S rRNA sequences or ITS sequences are often used for making distinctions between species and strains, in that if one of the aforementioned sequences share less than a specified percent sequence identity from a reference sequence, then the two organisms from which the sequences were obtained are said to be of different species or strains.

Thus, one could consider microbes to be of the same species, if they share at least 80%, 85%, 90%, 95%, 97%, 98%, or 99% sequence identity across the 16S or 18S rRNA sequence, or the ITS1 or ITS2 sequence.

Further, one could define microbial strains of a species, as those that share at least 80%, 85%, 90%, 95%, 97%, 98%, or 99% sequence identity across the 16S or 18S rRNA sequence, or the ITS1 or ITS2 sequence.

In one embodiment, microbial strains of the present disclosure include those that comprise polynucleotide sequences that share at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity with any one of SEQ ID NOs:1, 2, 3, 4, 5, 6, 7, 8, 9, 10, 11, 12, 13, 14, 15, 16, 17, 18, 19, 20, 21, 22, 23, 24, 25, 26, 27, 28, 39, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 2045, 2046, 2047, 2048, 2049, 2050, 2051, 2052, 2053, 2054, 2055, 2056, 2057, 2058, 2059, 2060, 2061, 2062, 2063, 2064, 2065, 2066, 2067, 2068, 2069, 2070, 2071, 2072, 2073, 2074, 2075, 2076, 2077, 2078, 2079, 2080, 2081, 2082, 2083, 2084, 2085, 2086, 2087, 2088, 2089, 2090, 2091, 2092, 2093, 2094, 2095, 2096, 2097, 2098, 2099, 2100, 2101, 2102, 2103, 2104, 2105, 2106, and 2107. In a further embodiment, microbial strains of the present disclosure include those that comprise polynucleotide sequences that share at least 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity with any one of SEQ ID NOs:1-2107.

Comparisons may also be made with 23S rRNA sequences against reference sequences.

Unculturable microbes often cannot be assigned to a definite species in the absence of a phenotype determination, the microbes can be given a candidatus designation within a genus provided their 16S or 18S rRNA sequences or ITS sequences subscribes to the principles of identity with known species.

One approach is to observe the distribution of a large number of strains of closely related species in sequence space and to identify clusters of strains that are well resolved from other clusters. This approach has been developed by using the concatenated sequences of multiple core (housekeeping) genes to assess clustering patterns, and has been called multilocus sequence analysis (MLSA) or multilocus sequence phylogenetic analysis. MLSA has been used successfully to explore clustering patterns among large numbers of strains assigned to very closely related species by current taxonomic methods, to look at the relationships between small numbers of strains within a genus, or within a broader taxonomic grouping, and to address specific taxonomic questions. More generally, the method can be used to ask whether bacterial species exist—that is, to observe whether large populations of similar strains invariably fall into well-resolved clusters, or whether in some cases there is a genetic continuum in which clear separation into clusters is not observed.

In order to more accurately make a determination of genera, a determination of phenotypic traits, such as morphological, biochemical, and physiological characteristics are made for comparison with a reference genus archetype. The colony morphology can include color, shape, pigmentation, production of slime, etc. Features of the cell are described as to shape, size, Gram reaction, extracellular material, presence of endospores, flagella presence and location, motility, and inclusion bodies. Biochemical and physiological features describe growth of the organism at different ranges of temperature, pH, salinity and atmospheric conditions, growth in presence of different sole carbon and nitrogen sources. One of ordinary skill in the art would be reasonably apprised as to the phenotypic traits that define the genera of the present disclosure.

In one embodiment, the microbes taught herein were identified utilizing 16S rRNA gene sequences and ITS sequences. It is known in the art that 16S rRNA contains hypervariable regions that can provide species/strain-specific signature sequences useful for bacterial identification, and that ITS sequences can also provide species/strain-specific signature sequences useful for fungal identification.

Phylogenetic analysis using the rRNA genes and/or ITS sequences are used to define "substantially similar" species belonging to common genera and also to define "substantially similar" strains of a given taxonomic species. Furthermore, physiological and/or biochemical properties of the isolates can be utilized to highlight both minor and significant differences between strains that could lead to advantageous behavior in ruminants.

Compositions of the present disclosure may include combinations of fungal spores and bacterial spores, fungal spores and bacterial vegetative cells, fungal vegetative cells and bacterial spores, fungal vegetative cells and bacterial vegetative cells. In some embodiments, compositions of the present disclosure comprise bacteria only in the form of spores. In some embodiments, compositions of the present disclosure comprise bacteria only in the form of vegetative cells. In some embodiments, compositions of the present disclosure comprise bacteria in the absence of fungi. In some embodiments, compositions of the present disclosure comprise fungi in the absence of bacteria.

Bacterial spores may include endospores and akinetes. Fungal spores may include statismospores, ballistospores, autospores, aplanospores, zoospores, mitospores, megaspores, microspores, meiospores, chlamydospores, urediniospores, teliospores, oospores, carpospores, tetraspores, sporangiospores, zygospores, ascospores, basidiospores, ascospores, and asciospores.

In some embodiments, spores of the composition germinate upon administration to animals of the present disclosure. In some embodiments, spores of the composition germinate only upon administration to animals of the present disclosure.

Microbial Compositions

In some embodiments, the microbes of the disclosure are combined into microbial compositions.

In some embodiments, the microbial compositions include ruminant feed, such as cereals (barley, maize, oats, and the like); starches (tapioca and the like); oilseed cakes; and vegetable wastes. In some embodiments, the microbial compositions include vitamins, minerals, trace elements, emulsifiers, aromatizing products, binders, colorants, odorants, thickening agents, and the like.

In some embodiments, the microbial compositions of the present disclosure are solid. Where solid compositions are used, it may be desired to include one or more carrier materials including, but not limited to: mineral earths such as silicas, talc, kaolin, limestone, chalk, clay, dolomite, diatomaceous earth; calcium sulfate; magnesium sulfate; magnesium oxide; products of vegetable origin such as cereal meals, tree bark meal, wood meal, and nutshell meal.

In some embodiments, the microbial compositions of the present disclosure are liquid. In further embodiments, the liquid comprises a solvent that may include water or an alcohol, and other animal-safe solvents. In some embodiments, the microbial compositions of the present disclosure include binders such as animal-safe polymers, carboxymethylcellulose, starch, polyvinyl alcohol, and the like.

In some embodiments, the microbial compositions of the present disclosure comprise thickening agents such as silica, clay, natural extracts of seeds or seaweed, synthetic derivatives of cellulose, guar gum, locust bean gum, alginates, and methylcelluloses. In some embodiments, the microbial compositions comprise anti-settling agents such as modified starches, polyvinyl alcohol, xanthan gum, and the like.

In some embodiments, the microbial compositions of the present disclosure comprise colorants including organic chromophores classified as nitroso; nitro; azo, including monoazo, bisazo and polyazo; acridine, anthraquinone, azine, diphenylmethane, indamine, indophenol, methine, oxazine, phthalocyanine, thiazine, thiazole, triarylmethane, xanthene. In some embodiments, the microbial compositions of the present disclosure comprise trace nutrients such as salts of iron, manganese, boron, copper, cobalt, molybdenum and zinc.

In some embodiments, the microbial compositions of the present disclosure comprise an animal-safe virucide or nematicide.

In some embodiments, microbial compositions of the present disclosure comprise saccharides (e.g., monosaccharides, disaccharides, trisaccharides, polysaccharides, oligosaccharides, and the like), polymeric saccharides, lipids, polymeric lipids, lipopolysaccharides, proteins, polymeric proteins, lipoproteins, nucleic acids, nucleic acid polymers, silica, inorganic salts and combinations thereof. In a further embodiment, microbial compositions comprise polymers of agar, agarose, gelrite, gellan gumand the like. In some embodiments, microbial compositions comprise plastic capsules, emulsions (e.g., water and oil), membranes, and artificial membranes. In some embodiments, emulsions or linked polymer solutions may comprise microbial compositions of the present disclosure. See Harel and Bennett (U.S. Pat. No. 8,460,726B2).

In some embodiments, microbial compositions of the present disclosure occur in a solid form (e.g., dispersed lyophilized spores) or a liquid form (microbes interspersed in a storage medium).

In some embodiments, microbial compositions of the present disclosure comprise one or more preservatives. The preservatives may be in liquid or gas formulations. The preservatives may be selected from one or more of monosaccharide, disaccharide, trisaccharide, polysaccharide, acetic acid, ascorbic acid, calcium ascorbate, erythorbic acid, iso-ascorbic acid, erythrobic acid, potassium nitrate, sodium ascorbate, sodium erythorbate, sodium iso-ascorbate, sodium nitrate, sodium nitrite, nitrogen, benzoic acid, calcium sorbate, ethyl lauroyl arginate, methyl-p-hydroxy benzoate, methyl paraben, potassium acetate, potassium benzoiate, potassium bisulphite, potassium diacetate, potassium lactate, potassium metabisulphite, potassium sorbate, propyl-p-hydroxy benzoate, propyl paraben, sodium acetate, sodium benzoate, sodium bisulphite, sodium nitrite, sodium diacetate, sodium lactate, sodium metabisulphite, sodium salt of methyl-p-hydroxy benzoic acid, sodium salt of propyl-p-hydroxy benzoic acid, sodium sulphate, sodium sulfite, sodium dithionite, sulphurous acid, calcium propionate, dimethyl dicarbonate, natamycin, potassium sorbate, potassium bisulfite, potassium metabisulfite, propionic acid, sodium diacetate, sodium propionate, sodium sorbate, sorbic acid, ascorbic acid, ascorbyl palmitate, ascorbyl stearate, butylated hydro-xyanisole, butylated hydroxytoluene (BHT), butylated hydroxyl anisole (BHA), citric acid, citric acid esters of mono- and/or diglycerides, L-cysteine, L-cysteine hydrochloride, gum guaiacum, gum guaiac, lecithin, lecithin citrate, monoglyceride citrate, monoisopropyl citrate, propyl gallate, sodium metabisulphite, tartaric acid, tertiary butyl hydroquinone, stannous chloride, thiodipropionic acid, dilauryl thiodipropionate, distearyl thiodipropionate, ethoxyquin, sulfur dioxide, formic acid, or tocopherol(s).

In some embodiments, microbial compositions of the present disclosure include bacterial and/or fungal cells in spore form, vegetative cell form, and/or lysed cell form. In one embodiment, the lysed cell form acts as a mycotoxin binder, e.g. mycotoxins binding to dead cells.

In some embodiments, the microbial compositions are shelf stable in a refrigerator (35-40° F.) for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days. In some embodiments, the microbial compositions are shelf stable in a refrigerator (35-40° F.) for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks.

In some embodiments, the microbial compositions are shelf stable at room temperature (68-72° F.) or between 50-77° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days. In some embodiments, the microbial compositions are shelf stable at room temperature (68-72° F.) or between 50-77° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks.

In some embodiments, the microbial compositions are shelf stable at −23-35° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days. In some embodiments, the microbial compositions are shelf stable at −23-35° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks.

In some embodiments, the microbial compositions are shelf stable at 77-100° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days. In some embodiments, the microbial compositions are shelf stable at 77-100° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks.

In some embodiments, the microbial compositions are shelf stable at 101-213° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 days. In some embodiments, the microbial compositions are shelf stable at 101-213° F. for a period of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, or 60 weeks.

In some embodiments, the microbial compositions of the present disclosure are shelf stable at refrigeration temperatures (35-40° F.), at room temperature (68-72° F.), between 50-77° F., between −23-35° F., between 70-100° F., or between 101-213° F. for a period of about 1 to 100, about 1 to 95, about 1 to 90, about 1 to 85, about 1 to 80, about 1 to 75, about 1 to 70, about 1 to 65, about 1 to 60, about 1 to 55, about 1 to 50, about 1 to 45, about 1 to 40, about 1 to 35, about 1 to 30, about 1 to 25, about 1 to 20, about 1 to 15, about 1 to 10, about 1 to 5, about 5 to 100, about 5 to 95, about 5 to 90, about 5 to 85, about 5 to 80, about 5 to 75, about 5 to 70, about 5 to 65, about 5 to 60, about 5 to 55, about 5 to 50, about 5 to 45, about 5 to 40, about 5 to 35, about 5 to 30, about 5 to 25, about 5 to 20, about 5 to 15, about 5 to 10, about 10 to 100, about 10 to 95, about 10 to 90, about 10 to 85, about 10 to 80, about 10 to 75, about 10 to 70, about 10 to 65, about 10 to 60, about 10 to 55, about 10 to 50, about 10 to 45, about 10 to 40, about 10 to 35, about 10 to 30, about 10 to 25, about 10 to 20, about 10 to 15, about 15 to 100, about 15 to 95, about 15 to 90, about 15 to 85, about 15 to 80, about 15 to 75, about 15 to 70, about 15 to 65, about 15 to 60, about 15 to 55, about 15 to 50, about 15 to 45, about 15 to 40, about 15 to 35, about 15 to 30, about 15 to 25, about 15 to 20, about 20 to 100, about 20 to 95, about 20 to 90, about 20 to 85, about 20 to 80, about 20 to 75, about 20 to 70, about 20 to 65, about 20 to 60, about 20 to 55, about 20 to 50, about 20 to 45, about 20 to 40, about 20 to 35, about 20 to 30, about 20 to 25, about 25 to 100, about 25 to 95, about 25 to 90, about 25 to 85, about 25 to 80, about 25 to 75, about 25 to 70, about 25 to 65, about 25 to 60, about 25 to 55, about 25 to 50, about 25 to 45, about 25 to 40, about 25 to 35, about 25 to 30, about 30 to 100, about 30 to 95, about 30 to 90, about 30 to 85, about 30 to 80, about 30 to 75, about 30 to 70, about 30 to 65, about 30 to 60, about 30 to 55, about 30 to 50, about 30 to 45, about 30 to 40, about 30 to 35, about 35 to 100, about 35 to 95, about 35 to 90, about 35 to 85, about 35 to 80, about 35 to 75, about 35 to 70, about 35 to 65, about 35 to 60, about 35 to 55, about 35 to 50, about 35 to 45, about 35 to 40, about 40 to 100, about 40 to 95, about 40 to 90, about 40 to 85, about 40 to 80, about 40 to 75, about 40 to 70, about 40 to 65, about 40 to 60, about 40 to 55, about 40 to 50, about 40 to 45, about 45 to 100, about 45 to 95, about 45 to 90, about 45 to 85, about 45 to 80, about 45 to 75, about 45 to 70, about 45 to 65, about 45 to 60, about 45 to 55, about 45 to 50, about 50 to 100, about 50 to 95, about 50 to 90, about 50 to 85, about 50 to 80, about 50 to 75, about 50 to 70, about 50 to 65, about 50 to 60, about 50 to 55, about 55 to 100, about 55 to 95, about 55 to 90, about 55 to 85, about 55 to 80, about 55 to 75, about 55 to 70, about 55 to 65, about 55 to 60, about 60 to 100, about 60 to 95, about 60 to 90, about 60 to 85, about 60 to 80, about 60 to 75, about 60 to 70, about 60 to 65, about 65 to 100, about 65 to 95, about 65 to 90, about 65 to 85, about 65 to 80, about 65 to 75, about 65 to 70, about 70 to 100, about 70 to 95, about 70 to 90, about 70 to 85, about 70 to 80, about 70 to 75, about 75 to 100, about 75 to 95, about 75 to 90, about 75 to 85, about 75 to 80, about 80 to 100, about 80 to 95, about 80 to 90, about 80 to 85, about 85 to 100, about 85 to 95, about 85 to 90, about 90 to 100, about 90 to 95, or 95 to 100 weeks In some embodiments, the microbial compositions of the present disclosure are shelf stable at refrigeration temperatures (35-40° F.), at room temperature (68-72° F.), between 50-77° F., between −23-35° F., between 70-100° F., or between 101-213° F. for a period of 1 to 100, 1 to 95, 1 to 90, 1 to 85, 1 to 80, 1 to 75, 1 to 70, 1 to 65, 1 to 60, 1 to 55, 1 to 50, 1 to 45, 1 to 40, 1 to 35, 1 to 30, 1 to 25, 1 to 20, 1 to 15, 1 to 10, 1 to 5, 5 to 100, 5 to 95, 5 to 90, 5 to 85, 5 to 80, 5 to 75, 5 to 70, 5 to 65, 5 to 60, 5 to 55, 5 to 50, 5 to 45, 5 to 40, 5 to 35, 5 to 30, 5 to 25, 5 to 20, 5 to 15, 5 to 10, 10 to 100, 10 to 95, 10 to 90, 10 to 85, 10 to 80, 10 to 75, 10 to 70, 10 to 65, 10 to 60, 10 to 55, 10 to 50, 10 to 45, 10 to 40, 10 to 35, 10 to 30, 10 to 25, 10 to 20, 10 to 15, 15 to 100, 15 to 95, 15 to 90, 15 to 85, 15 to 80, 15 to 75, 15 to 70, 15 to 65, 15 to 60, 15 to 55, 15 to 50, 15 to 45, 15 to 40, 15 to 35, 15 to 30, 15 to 25, 15 to 20, 20 to 100, 20 to 95, 20 to 90, 20 to 85, 20 to 80, 20 to 75, 20 to 70, 20 to 65, 20 to 60, 20 to 55, 20 to 50, 20 to 45, 20 to 40, 20 to 35, 20 to 30, 20 to 25, 25 to 100, 25 to 95, 25 to 90, 25 to 85, 25 to 80, 25 to 75, 25 to 70, 25 to 65, 25 to 60, 25 to 55, 25 to 50, 25 to 45, 25 to 40, 25 to 35, 25 to 30, 30 to 100, 30 to 95, 30 to 90, 30 to 85, 30 to 80, 30 to 75, 30 to 70, 30 to 65, 30 to 60, 30 to 55, 30 to 50, 30 to 45, 30 to 40, 30 to 35, 35 to 100, 35 to 95, 35 to 90, 35 to 85, 35 to 80, 35 to 75, 35 to 70, 35 to 65, 35 to 60, 35 to 55, 35 to 50, 35 to 45, 35 to 40, 40 to 100, 40 to 95, 40 to 90, 40 to 85, 40 to 80, 40 to 75, 40 to 70, 40 to 65, 40 to 60, 40 to 55, 40 to 50, 40 to 45, 45 to 100, 45 to 95, 45 to 90, 45 to 85, 45 to 80, 45 to 75, 45 to 70, 45 to 65, 45 to 60, 45 to 55, 45 to 50, 50 to 100, 50 to 95, 50 to 90, 50 to 85, 50 to 80, 50 to 75, 50 to 70, 50 to 65, 50 to 60, 50 to 55, 55 to 100, 55 to 95, 55 to 90, 55 to 85, 55 to 80, 55 to 75, 55 to 70, 55 to 65, 55 to 60, 60 to 100, 60 to 95, 60 to 90, 60 to 85, 60 to 80, 60 to 75, 60 to 70, 60 to 65, 65 to 100, 65 to 95, 65 to 90, 65 to 85, 65 to 80, 65 to 75, 65 to 70, 70 to 100, 70 to 95, 70 to 90, 70 to 85, 70 to 80, 70 to 75, 75 to 100, 75 to 95, 75 to 90, 75 to 85, 75 to 80, 80 to 100, 80 to 95, 80 to 90, 80 to 85, 85 to 100, 85 to 95, 85 to 90, 90 to 100, 90 to 95, or 95 to 100 weeks.

In some embodiments, the microbial compositions of the present disclosure are shelf stable at refrigeration temperatures (35-40° F.), at room temperature (68-72° F.), between 50-77° F., between −23-35° F., between 70-100° F., or between 101-213° F. for a period of about 1 to 36, about 1 to 34, about 1 to 32, about 1 to 30, about 1 to 28, about 1 to 26, about 1 to 24, about 1 to 22, about 1 to 20, about 1 to 18, about 1 to 16, about 1 to 14, about 1 to 12, about 1 to 10, about 1 to 8, about 1 to 6, about 1 one 4, about 1 to 2, about 4 to 36, about 4 to 34, about 4 to 32, about 4 to 30, about 4 to 28, about 4 to 26, about 4 to 24, about 4 to 22, about 4 to 20, about 4 to 18, about 4 to 16, about 4 to 14, about 4 to 12, about 4 to 10, about 4 to 8, about 4 to 6, about 6 to 36, about 6 to 34, about 6 to 32, about 6 to 30, about 6 to 28, about 6 to 26, about 6 to 24, about 6 to 22, about 6 to 20, about 6 to 18, about 6 to 16, about 6 to 14, about 6 to 12, about 6 to 10, about 6 to 8, about 8 to 36, about 8 to 34, about 8 to 32, about 8 to 30, about 8 to 28, about 8 to 26, about 8 to 24, about 8 to 22, about 8 to 20, about 8 to 18, about 8 to 16, about 8 to 14, about 8 to 12, about 8 to 10, about 10 to 36, about 10 to 34, about 10 to 32, about 10 to 30, about 10 to 28, about 10 to 26, about 10 to 24, about 10 to 22, about 10 to 20, about 10 to 18, about 10 to 16, about 10 to 14, about 10 to 12, about 12 to 36, about 12 to 34, about 12 to 32, about 12 to 30, about 12 to 28, about 12 to 26, about 12 to 24, about 12 to 22, about 12 to 20, about 12 to 18, about 12 to 16, about 12 to 14, about 14 to 36, about 14 to 34, about 14 to 32, about 14 to 30, about 14 to 28, about 14 to 26, about 14 to 24, about 14 to 22, about 14 to 20, about 14 to 18, about 14 to 16, about 16 to 36, about 16 to 34, about 16 to 32, about 16 to 30, about 16 to 28, about 16 to 26, about 16 to 24, about 16 to 22, about 16 to 20, about 16 to 18, about 18 to 36, about 18 to 34, about 18 to 32, about 18 to 30, about 18 to 28, about 18 to 26, about 18 to 24, about 18 to 22, about 18 to 20, about 20 to 36, about 20 to 34, about 20 to 32, about 20 to 30, about 20 to 28, about 20 to 26, about 20 to 24, about 20 to 22, about 22 to 36, about 22 to 34, about 22 to 32, about 22 to 30, about 22 to 28, about 22 to 26, about 22 to 24, about 24 to 36, about 24 to 34, about 24 to 32, about 24 to 30, about 24 to 28, about 24 to 26, about 26 to 36, about 26 to 34, about 26 to 32, about 26 to 30, about 26 to 28, about 28 to 36, about 28 to 34, about 28 to 32, about 28 to 30, about 30 to 36, about 30 to 34, about 30 to 32, about 32 to 36, about 32 to 34, or about 34 to 36 months.

In some embodiments, the microbial compositions of the present disclosure are shelf stable at refrigeration temperatures (35-40° F.), at room temperature (68-72° F.), between 50-77° F., between −23-35° F., between 70-100° F., or between 101-213° F. for a period of 1 to 36 1 to 34 1 to 32 1 to 30 1 to 28 1 to 26 1 to 24 1 to 22 1 to 20 1 to 18 1 to 16 1 to 14 1 to 12 1 to 10 1 to 8 1 to 6 1 one 4 1 to 2 4 to 36 4 to 34 4 to 32 4 to 30 4 to 28 4 to 26 4 to 24 4 to 22 4 to 20 4 to 18 4 to 16 4 to 14 4 to 12 4 to 10 4 to 8 4 to 6 6 to 36 6 to 34 6 to 32 6 to 30 6 to 28 6 to 26 6 to 24 6 to 22 6 to 20 6 to 18 6 to 16 6 to 14 6 to 12 6 to 10 6 to 8 8 to 36 8 to 34 8 to 32 8 to 308 to 28 8 to 26 8 to 24 8 to 22 8 to 20 8 to 18 8 to 16 8 to 14 8 to 12 8 to 10 10 to 36 10 to 34 10 to 32 10 to 30 10 to 28 10 to 26 10 to 24 10 to 22 10 to 20 10 to 18 10 to 16 10 to 14 10 to 12 12 to 36 12 to 34 12 to 32 12 to 30 12 to 28 12 to 26 12 to 24 12 to 22 12 to 20 12 to 18 12 to 16 12 to 14 14 to 36 14 to 34 14 to 32 14 to 30 14 to 28 14 to 26 14 to 24 14 to 22 14 to 20 14 to 18 14 to 16 16 to 36 16 to 34 16 to 32 16 to 30 16 to 28 16 to 26 16 to 24 16 to 22 16 to 20 16 to 18 18 to 36 18 to 34 18 to 32 18 to 30 18 to 28 18 to 26 18 to 24 18 to 22 18 to 20 20 to 36 20 to 34 20 to 32 20 to 30 20 to 28 20 to 26 20 to 24 20 to 22 22 to 36 22 to 34 22 to 32 22 to 30 22 to 28 22 to 26 22 to 24 24 to 36 24 to 34 24 to 32 24 to 30 24 to 28 24 to 26 26 to 36 26 to 34 26 to 32 26 to 30 26 to 28 28 to 36 28 to 34 28 to 32 28 to 30 30 to 36 30 to 34 30 to 32 32 to 36 32 to 34, or about 34 to 36.

In some embodiments, the microbial compositions of the present disclosure are shelf stable at any of the disclosed temperatures and/or temperature ranges and spans of time at a relative humidity of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, or 98%

Encapsulation Compositions

In some embodiments, the microbes or microbial compositions of the disclosure are encapsulated in an encapsulating composition. An encapsulating composition protects the microbes from external stressors prior to entering the gastrointestinal tract of ungulates. Encapsulating compositions further create an environment that may be beneficial to the microbes, such as minimizing the oxidative stresses of an aerobic environment on anaerobic microbes. See Kalsta et al. (U.S. Pat. No. 5,104,662A), Ford (U.S. Pat. No. 5,733,568A), and Mosbach and Nilsson (U.S. Pat. No. 4,647,536A) for encapsulation compositions of microbes, and methods of encapsulating microbes.

In one embodiment, the encapsulating composition comprises microcapsules having a multiplicity of liquid cores encapsulated in a solid shell material. For purposes of the disclosure, a "multiplicity" of cores is defined as two or more.

A first category of useful fusible shell materials is that of normally solid fats, including fats which are already of suitable hardness and animal or vegetable fats and oils which are hydrogenated until their melting points are sufficiently high to serve the purposes of the present disclosure. Depending on the desired process and storage temperatures and the specific material selected, a particular fat can be either a normally solid or normally liquid material. The terms "normally solid" and "normally liquid" as used herein refer to the state of a material at desired temperatures for storing the resulting microcapsules. Since fats and hydrogenated oils do not, strictly speaking, have melting points, the term "melting point" is used herein to describe the minimum temperature at which the fusible material becomes sufficiently softened or liquid to be successfully emulsified and spray cooled, thus roughly corresponding to the maximum temperature at which the shell material has sufficient integrity to prevent release of the choline cores. "Melting point" is similarly defined herein for other materials which do not have a sharp melting point.

Specific examples of fats and oils useful herein (some of which require hardening) are as follows: animal oils and fats, such as beef tallow, mutton tallow, lamb tallow, lard or pork fat, fish oil, and sperm oil; vegetable oils, such as canola oil, cottonseed oil, peanut oil, corn oil, olive oil, soybean oil, sunflower oil, safflower oil, coconut oil, palm oil, linseed oil, tung oil, and castor oil; fatty acid monoglycerides and diglycerides; free fatty acids, such as stearic acid, palmitic acid, and oleic acid; and mixtures thereof. The above listing of oils and fats is not meant to be exhaustive, but only exemplary.

Specific examples of fatty acids include linoleic acid, γ-linoleic acid, dihomo-γ-linolenic acid, arachidonic acid, docosatetraenoic acid, vaccenic acid, nervonic acid, mead acid, erucic acid, gondoic acid, elaidic acid, oleic acid, palitoleic acid, stearidonic acid, eicosapentaenoic acid, valeric acid, caproic acid, enanthic acid, caprylic acid, pelargonic acid, capric acid, undecylic acid, lauric acid, tridecylic acid, myristic acid, pentadecylic acid, palmitic acid, margaric acid, stearic acid, nonadecyclic acid, arachidic acid, heneicosylic acid, behenic acid, tricosylic acid, lignoceric acid, pentacosylic acid, cerotic acid, heptacosylic acid, montanic acid, nonacosylic acid, melissic acid, henatriacontylic acid, lacceroic acid, psyllic acid, geddic acid, ceroplastic acid, hexatriacontylic acid, heptatriacontanoic acid, and octatriacontanoic acid.

Another category of fusible materials useful as encapsulating shell materials is that of waxes. Representative waxes contemplated for use herein are as follows: animal waxes, such as beeswax, lanolin, shell wax, and Chinese insect wax; vegetable waxes, such as carnauba, candelilla, bayberry, and sugar cane; mineral waxes, such as paraffin, microcrystalline petroleum, ozocerite, ceresin, and montan; synthetic waxes, such as low molecular weight polyolefin (e.g., CARBOWAX), and polyol ether-esters (e.g., sorbitol); Fischer-Tropsch process synthetic waxes; and mixtures thereof. Water-soluble waxes, such as CARBOWAX and sorbitol, are not contemplated herein if the core is aqueous.

Still other fusible compounds useful herein are fusible natural resins, such as rosin, balsam, shellac, and mixtures thereof.

Various adjunct materials are contemplated for incorporation in fusible materials according to the present disclosure. For example, antioxidants, light stabilizers, dyes and lakes, flavors, essential oils, anti-caking agents, fillers, pH stabilizers, sugars (monosaccharides, disaccharides, trisaccharides, and polysaccharides) and the like can be incorporated in the fusible material in amounts which do not diminish its utility for the present disclosure.

The core material contemplated herein constitutes from about 0.1% to about 50%, about 1% to about 35%. or about 5% to about 30% by weight of the microcapsules. In some embodiments, the core material contemplated herein constitutes no more than about 30% by weight of the microcapsules. In some embodiments, the core material contemplated herein constitutes about 5% by weight of the microcapsules. The core material is contemplated as either a liquid or solid at contemplated storage temperatures of the microcapsules.

The cores may include other additives well-known in the pharmaceutical art, including edible sugars, such as sucrose, glucose, maltose, fructose, lactose, cellobiose, monosaccharides, disaccharides, trisaccharides, polysaccharides, and mixtures thereof; artificial sweeteners, such as aspartame, saccharin, cyclamate salts, and mixtures thereof edible acids, such as acetic acid (vinegar), citric acid, ascorbic acid, tartaric acid, and mixtures thereof; edible starches, such as corn starch; hydrolyzed vegetable protein; water-soluble vitamins, such as Vitamin C; water-soluble medicaments; water-soluble nutritional materials, such as ferrous sulfate; flavors; salts; monosodium glutamate; antimicrobial agents, such as sorbic acid; antimycotic agents, such as potassium sorbate, sorbic acid, sodium benzoate, and benzoic acid; food grade pigments and dyes; and mixtures thereof. Other potentially useful supplemental core materials will be apparent to those of ordinary skill in the art.

Emulsifying agents may be employed to assist in the formation of stable emulsions. Representative emulsifying agents include glyceryl monostearate, polysorbate esters, ethoxylated mono- and diglycerides, and mixtures thereof.

For ease of processing, and particularly to enable the successful formation of a reasonably stable emulsion, the viscosities of the core material and the shell material should be similar at the temperature at which the emulsion is formed. In particular, the ratio of the viscosity of the shell to the viscosity of the core, expressed in centipoise or comparable units, and both measured at the temperature of the emulsion, should be from about 22:1 to about 1:1, desirably from about 8:1 to about 1:1, and preferably from about 3:1 to about 1:1. A ratio of 1:1 would be ideal, but a viscosity ratio within the recited ranges is useful.

Encapsulating compositions are not limited to microcapsule compositions as disclosed above. In some embodiments encapsulating compositions encapsulate the microbial compositions in an adhesive polymer that can be natural or synthetic without toxic effect. In some embodiments, the encapsulating composition may be a matrix selected from sugar matrix, gelatin matrix, polymer matrix, silica matrix, starch matrix, foam matrix, etc. In some embodiments, the encapsulating composition may be selected from polyvinyl acetates; polyvinyl acetate copolymers; ethylene vinyl acetate (EVA) copolymers; polyvinyl alcohols; polyvinyl alcohol copolymers; celluloses, including ethylcelluloses, methylcelluloses, hydroxymethylcelluloses, hydroxypropylcelluloses and carboxymethylcellulose; polyvinylpyrolidones; polysaccharides, including starch, modified starch, dextrins, maltodextrins, alginate and chitosans; monosaccharides; fats; fatty acids, including oils; proteins, including gelatin and zeins; gum arabics; shellacs; vinylidene chloride and vinylidene chloride copolymers; calcium lignosulfonates; acrylic copolymers; polyvinylacrylates; polyethylene oxide; acrylamide polymers and copolymers; polyhydroxyethyl acrylate, methylacrylamide monomers; and polychloroprene.

In some embodiments, the encapsulating shell of the present disclosure can be up to 10 μm, 20 μm, 30 μm, 40 μm, 50 μm, 60 μm, 70 μm, 80 μm, 90 μm, 100 μm, 110 μm, 120 μm, 130 μm, 140 μm, 150 μm, 160 μm, 170 μm, 180 μm, 190 μm, 200 μm, 210 μm, 220 μm, 230 μm, 240 μm, 250 μm, 260 μm, 270 μm, 280 μm, 290 μm, 300 μm, 310 μm, 320 μm, 330 μm, 340 μm, 350 μm, 360 μm, 370 μm, 380 μm, 390 μm, 400 μm, 410 μm, 420 μm, 430 μm, 440 μm, 450 μm, 460 μm, 470 μm, 480 μm, 490 μm, 500 μm, 510 μm, 520 μm, 530 μm, 540 μm, 550 μm, 560 μm, 570 μm, 580 μm, 590 μm, 600 μm, 610 μm, 620 μm, 630 μm, 640 μm, 650 μm, 660 μm, 670 μm, 680 μm, 690 μm, 700 μm, 710 μm, 720 μm, 730 μm, 740 μm, 750 μm, 760 μm, 770 μm, 780 μm, 790 μm, 800 μm, 810 μm, 820 μm, 830 μm, 840 μm, 850 μm, 860 μm, 870 μm, 880 μm, 890 μm, 900 μm, 910 μm, 920 μm, 930 μm, 940 μm, 950 μm, 960 μm, 970 μm, 980 μm, 990 μm, 1000 μm, 1010 μm, 1020 μm, 1030 μm, 1040 μm, 1050 μm, 1060 μm, 1070 μm, 1080 μm, 1090 μm, 1100 μm, 1110 μm, 1120 μm, 1130 μm, 1140 μm, 1150 μm, 1160 μm, 1170 μm, 1180 μm, 1190 μm, 1200 μm, 1210 μm, 1220 μm, 1230 μm, 1240 μm, 1250 μm, 1260 μm, 1270 μm, 1280 μm, 1290 μm, 1300 μm, 1310 μm, 1320 μm, 1330 μm, 1340 μm, 1350 μm, 1360 μm, 1370 μm, 1380 μm, 1390 μm, 1400 μm, 1410 μm, 1420 μm, 1430 μm, 1440 μm, 1450 μm, 1460 μm, 1470 μm, 1480 μm, 1490 μm, 1500 μm, 1510 μm, 1520 μm, 1530 μm, 1540 μm, 1550 μm, 1560 μm, 1570 μm, 1580 μm, 1590 μm, 1600 μm, 1610 μm, 1620 μm, 1630 μm, 1640 μm, 1650 μm, 1660 μm, 1670 μm, 1680 μm, 1690 μm, 1700 μm, 1710 μm, 1720 μm, 1730 μm, 1740 μm, 1750 μm, 1760 μm, 1770 μm, 1780 μm, 1790 μm, 1800 μm, 1810 μm, 1820 μm, 1830 μm, 1840 μm, 1850 μm, 1860 μm, 1870 μm, 1880 μm, 1890 μm, 1900 μm, 1910 μm, 1920 μm, 1930 μm, 1940 μm, 1950 μm, 1960 μm, 1970 μm, 1980 μm, 1990 μm, 2000 μm, 2010 μm, 2020 μm, 2030 μm, 2040 μm, 2050 μm, 2060 μm, 2070 μm, 2080 μm, 2090 μm, 2100 μm, 2110 μm, 2120 μm, 2130 μm, 2140 μm, 2150 μm, 2160 μm, 2170 μm, 2180 μm, 2190 μm, 2200 μm, 2210 μm, 2220 μm, 2230 μm, 2240 μm, 2250 μm, 2260 μm, 2270 μm, 2280 μm, 2290 μm, 2300 μm, 2310 μm, 2320 μm, 2330 μm, 2340 μm, 2350 μm, 2360 μm, 2370 μm, 2380 μm, 2390 μm, 2400 μm, 2410 μm, 2420 μm, 2430 μm, 2440 μm, 2450 μm, 2460 μm, 2470 μm, 2480 μm, 2490 μm, 2500 μm, 2510 μm, 2520 μm, 2530 μm, 2540 μm, 2550 μm, 2560 μm, 2570 μm, 2580 μm, 2590 μm, 2600 μm, 2610 μm, 2620 μm, 2630 μm, 2640 μm, 2650 μm, 2660 μm, 2670 μm, 2680 μm, 2690 μm, 2700 μm, 2710 μm, 2720 μm, 2730 μm, 2740 μm, 2750 μm, 2760 μm, 2770 μm, 2780 μm, 2790 μm, 2800 μm, 2810 μm, 2820 μm, 2830 μm, 2840 μm, 2850 μm, 2860 μm, 2870 μm, 2880 μm, 2890 μm, 2900 μm, 2910 μm, 2920 μm, 2930 μm, 2940 μm, 2950 μm, 2960 μm, 2970 μm, 2980 μm, 2990 μm, or 3000 μm thick.

Animal Feed

In some embodiments, compositions of the present disclosure are mixed with animal feed. In some embodiments, animal feed may be present in various forms such as pellets, capsules, granulated, powdered, liquid, or semi-liquid.

In some embodiments, compositions of the present disclosure are mixed into the premix at at the feed mill (e.g., Carghill or Western Millin), alone as a standalone premix, and/or alongside other feed additives such as MONENSIN, vitamins, etc. In one embodiment, the compositions of the present disclosure are mixed into the feed at the feed mill. In another embodiment, compositions of the present disclosure are mixed into the feed itself.

In some embodiments, feed of the present disclosure may be supplemented with water, premix or premixes, forage, fodder, beans (e.g., whole, cracked, or ground), grains (e.g., whole, cracked, or ground), bean- or grain-based oils, bean- or grain-based meals, bean- or grain-based haylage or silage, bean- or grain-based syrups, fatty acids, sugar alcohols (e.g., polyhydric alcohols), commercially available formula feeds, and mixtures thereof.

In some embodiments, forage encompasses hay, haylage, and silage. In some embodiments, hays include grass hays (e.g., sudangrass, orchardgrass, or the like), alfalfa hay, and clover hay. In some embodiments, haylages include grass haylages, sorghum haylage, and alfalfa haylage. In some embodiments, silages include maize, oat, wheat, alfalfa, clover, and the like.

In some embodiments, premix or premixes may be utilized in the feed. Premixes may comprise micro-ingredients such as vitamins, minerals, amino acids; chemical preservatives; pharmaceutical compositions such as antibiotics and other medicaments; fermentation products, and other ingredients. In some embodiments, premixes are blended into the feed.

In some embodiments, the feed may include feed concentrates such as soybean hulls, sugar beet pulp, molasses, high protein soybean meal, ground corn, shelled corn, wheat midds, distiller grain, cottonseed hulls, rumen-bypass protein, rumen-bypass fat, and grease. See Luhman (U.S. Publication US20150216817A1), Anderson et al. (U.S. Pat. No. 3,484,243) and Porter and Luhman (U.S. Pat. No. 9,179,694B2) for animal feed and animal feed supplements capable of use in the present compositions and methods.

In some embodiments, feed occurs as a compound, which includes, in a mixed composition capable of meeting the basic dietary needs, the feed itself, vitamins, minerals, amino acids, and other necessary components. Compound feed may further comprise premixes.

In some embodiments, microbial compositions of the present disclosure may be mixed with animal feed, premix, and/or compound feed. Individual components of the animal feed may be mixed with the microbial compositions prior to feeding to ruminants. The microbial compositions of the present disclosure may be applied into or on a premix, into or on a feed, and/or into or on a compound feed.

Administration of Microbial Compositions

In some embodiments, the microbial compositions of the present disclosure are administered to ruminants via the oral route. In some embodiments the microbial compositions are administered via a direct injection route into the gastrointestinal tract. In further embodiments, the direct injection administration delivers the microbial compositions directly to the rumen. In some embodiments, the microbial compositions of the present disclosure are administered to animals anally. In further embodiments, anal administration is in the form of an inserted suppository.

In some embodiments, the microbial composition is administered in a dose comprise a total of, or at least, 1 ml, 2 ml, 3 ml, 4 ml, 5 ml, 6 ml, 7 ml, 8 ml, 9 ml, 10 ml, 11 ml, 12 ml, 13 ml, 14 ml, 15 ml, 16 ml, 17 ml, 18 ml, 19 ml, 20 ml, 21 ml, 22 ml, 23 ml, 24 ml, 25 ml, 26 ml, 27 ml, 28 ml, 29 ml, 30 ml, 31 ml, 32 ml, 33 ml, 34 ml, 35 ml, 36 ml, 37 ml, 38 ml, 39 ml, 40 ml, 41 m, 42 ml, 43 ml, 44 ml, 45 ml, 46 ml, 47 ml, 48 ml, 49 ml, 50 ml, 60 ml, 70 ml, 80 ml, 90 ml, 100 ml, 200 ml, 300 ml, 400 ml, 500 ml, 600 ml, 700 ml, 800 ml, 900 ml, or 1,000 ml.

In some embodiments, the microbial composition is administered in a dose comprising a total of, or at least, $10^{18}$, $10^{17}$, $10^{16}$, $10^{15}$, $10^{14}$, $10^{13}$, $10^{12}$, $10^{11}$, $10^{10}$, $10^9$, $10^8$, $10^7$, $10^6$, $10^5$, $10^4$, $10^3$, or $10^2$ microbial cells.

In some embodiments, the microbial compositions are mixed with feed, and the administration occurs through the ingestion of the microbial compositions along with the feed. In some embodiments, the dose of the microbial composition is administered such that there exists $10^2$ to $10^{12}$, $10^3$ to $10^{12}$, $10^4$ to $10^{12}$, $10^5$ to $10^{12}$, $10^6$ to $10^{12}$, $10^7$ to $10^{12}$, $10^8$ to $10^{12}$, $10^9$ to $10^{12}$, $10^{10}$ to $10^{12}$, $10^{11}$ to $10^{12}$, $10^2$ to $10^{11}$, $10^3$ to $10^{11}$, $10^4$ to $10^{11}$, $10^5$ to $10^{11}$, $10^6$ to $10^{11}$, $10^7$ to $10^{11}$, $10^8$ to $10^{11}$, $10^9$ to $10^{11}$, $10^{10}$ to $10^{11}$, $10^2$ to $10^{10}$, $10^3$ to $10^{10}$, $10^4$ to $10^{10}$, $10^5$ to $10^{10}$, $10^6$ to $10^{10}$, $10^7$ to $10^{10}$, $10^8$ to $10^{10}$, $10^9$ to $10^{10}$, $10^2$ to $10^9$, $10^3$ to $10^9$, $10^4$ to $10^9$, $10^5$ to $10^9$, $10^6$ to $10^9$, $10^7$ to $10^9$, $10^8$ to $10^9$, $10^2$ to $10^8$, $10^3$ to $10^8$, $10^4$ to $10^8$, $10^5$ to $10^8$, $10^6$ to $10^8$, $10^7$ to $10^8$, $10^2$ to $10^7$, $10^3$ to $10^7$, $10^4$ to $10^7$, $10^5$ to $10^7$, $10^6$ to $10^7$, $10^2$ to $10^6$, $10^3$ to $10^6$, $10^4$ to $10^6$, $10^5$ to $10^6$, $10^2$ to $10^5$, $10^3$ to $10^5$, $10^4$ to $10^5$, $10^2$ to $10^4$, $10^3$ to $10^4$, $10^2$ to $10^3$, $10^{12}$, $10^{11}$, $10^{10}$, $10^9$, $10^8$, $10^7$, $10^6$, $10^5$, $10^4$, $10^3$, or $10^2$ total microbial cells per gram or milliliter of the composition.

In some embodiments, the administered dose of the microbial composition comprises $10^2$ to $10^{18}$, $10^3$ to $10^{18}$, $10^4$ to $10^{18}$, $10^5$ to $10^{18}$, $10^6$ to $10^{18}$, $10^7$ to $10^{18}$, $10^8$ to $10^{18}$, $10^9$ to $10^{18}$, $10^{10}$ to $10^{18}$, $10^{11}$ to $10^{18}$, $10^{12}$ to $10^{18}$, $10^{11}$ to $10^{18}$, $10^{14}$ to $10^{18}$, $10^{15}$ to $10^{18}$, $10^{16}$ to $10^{18}$, $10^{17}$ to $10^{18}$, $10^2$ to $10^{12}$, $10^3$ to $10^{12}$, $10^4$ to $10^{12}$, $10^5$ to $10^{12}$, $10^6$ to $10^{12}$, $10^7$ to $10^{12}$, $10^8$ to $10^{12}$, $10^9$ to $10^{12}$, $10^{10}$ to $10^{12}$, $10^{11}$ to $10^{12}$, $10^2$ to $10^{11}$, $10^3$ to $10^{11}$, $10^4$ to $10^{11}$, $10^5$ to $10^{11}$, $10^6$ to $10^{11}$, $10^7$ to $10^{11}$, $10^8$ to $10^{11}$, $10^9$ to $10^{11}$, $10^{10}$ to $10^{11}$, $10^2$ to $10^{10}$, $10^4$ to $10^{10}$, $10^5$ to $10^{10}$, $10^6$ to $10^{10}$, $10^7$ to $10^{10}$, $10^8$ to $10^{10}$, $10^9$ to $10^{10}$, $10^2$ to $10^9$, $10^3$ to $10^9$, $10^4$ to $10^9$, $10^5$ to $10^9$, $10^6$ to $10^9$, $10^7$ to $10^9$, $10^8$ to $10^9$, $10^2$ to $10^8$, $10^3$ to $10^8$, $10^4$ to $10^8$, $10^5$ to $10^8$, $10^6$ to $10^8$, $10^7$ to $10^8$, $10^2$ to $10^7$, $10^3$ to $10^7$, $10^4$ to $10^7$, $10^5$ to $10^7$, $10^6$ to $10^7$, $10^2$ to $10^6$, $10^3$ to $10^6$, $10^4$ to $10^6$, $10^5$ to $10^6$, $10^2$ to $10^5$, $10^3$ to $10^5$, $10^4$ to $10^5$, $10^2$ to $10^4$, $10^3$ to $10^4$, $10^2$ to $10^3$, $10^{18}$, $10^{17}$, $10^{16}$, $10^{15}$, $10^{14}$, $10^{13}$, $10^{12}$, $10^{11}$, $10^{10}$, $10^9$, $10^8$, $10^7$, $10^6$, $10^5$, $10^4$, $10^3$, or $10^2$ total microbial cells.

In some embodiments, the composition is administered 1 or more times per day. In some aspects, the composition is administered with food each time the animal is fed. In some embodiments, the composition is administered 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 times per day.

In some embodiments, the microbial composition is administered 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 times per week.

In some embodiments, the microbial composition is administered 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 times per month.

In some embodiments, the microbial composition is administered 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 times per year.

In some embodiments, the feed can be uniformly coated with one or more layers of the microbes and/or microbial compositions disclosed herein, using conventional methods of mixing, spraying, or a combination thereof through the use of treatment application equipment that is specifically designed and manufactured to accurately, safely, and efficiently apply coatings. Such equipment uses various types of coating technology such as rotary coaters, drum coaters, fluidized bed techniques, spouted beds, rotary mists, or a combination thereof. Liquid treatments such as those of the present disclosure can be applied via either a spinning "atomizer" disk or a spray nozzle, which evenly distributes the microbial composition onto the feed as it moves though the spray pattern. In some aspects, the feed is then mixed or tumbled for an additional period of time to achieve additional treatment distribution and drying.

In some embodiments, the feed coats of the present disclosure can be up to 10 µm, 20 µm, 30 µm, 40 µm, 50 µm, 60 µm, 70 µm, 80 µm, 90 µm, 100 µm, 110 µm, 120 µm, 130 µm, 140 µm, 150 µm, 160 µm, 170 µm, 180 µm, 190 µm, 200 µm, 210 µm, 220 µm, 230 µm, 240 µm, 250 µm, 260 µm, 270 µm, 280 µm, 290 µm, 300 µm, 310 µm, 320 µm, 330 µm, 340 µm, 350 µm, 360 µm, 370 µm, 380 µm, 390 µm, 400 µm, 410 µm, 420 µm, 430 µm, 440 µm, 450 µm, 460 µm, 470 µm, 480 µm, 490 µm, 500 µm, 510 µm, 520 µm, 530 µm, 540 µm, 550 µm, 560 µm, 570 µm, 580 µm, 590 µm, 600 µm, 610 µm, 620 µm, 630 µm, 640 µm, 650 µm, 660 µm, 670 µm, 680 µm, 690 µm, 700 µm, 710 µm, 720 µm, 730 µm, 740 µm, 750 µm, 760 µm, 770 µm, 780 µm, 790 µm, 800 µm, 810 µm, 820 µm, 830 µm, 840 µm, 850 µm, 860 µm, 870 µm, 880 µm, 890 µm, 900 µm, 910 µm, 920 µm, 930 µm, 940 µm, 950 µm, 960 µm, 970 µm, 980 µm, 990 µm, 1000 µm, 1010 µm, 1020 µm, 1030 µm, 1040 µm, 1050 µm, 1060 µm, 1070 µm, 1080 µm, 1090 µm, 1100 µm, 1110 µm, 1120 µm, 1130 µm, 1140 µm, 1150 µm, 1160 µm, 1170 µm, 1180 µm, 1190 µm, 1200 µm, 1210 µm, 1220 µm, 1230 µm, 1240 µm, 1250 µm, 1260 µm, 1270 µm, 1280 µm, 1290 µm, 1300 µm, 1310 µm, 1320 µm, 1330 µm, 1340 µm, 1350 µm, 1360 µm, 1370 µm, 1380 µm, 1390 µm, 1400 µm, 1410 µm, 1420 µm, 1430 µm, 1440 µm, 1450 µm, 1460 µm, 1470 µm, 1480 µm, 1490 µm, 1500 µm, 1510 µm, 1520 µm, 1530 µm, 1540 µm, 1550 µm, 1560 µm, 1570 µm, 1580 µm, 1590 µm, 1600 µm, 1610 µm, 1620 µm, 1630 µm, 1640 µm, 1650 µm, 1660 µm, 1670 µm, 1680 µm, 1690 µm, 1700 µm, 1710 µm, 1720 µm, 1730 µm, 1740 µm, 1750 µm, 1760 µm, 1770 µm, 1780 µm, 1790 µm, 1800 µm, 1810 µm, 1820 µm, 1830 µm, 1840 µm, 1850 µm, 1860 µm, 1870 µm, 1880 µm, 1890 µm, 1900 µm, 1910 µm, 1920 µm, 1930 µm, 1940 µm, 1950 µm, 1960 µm, 1970 µm, 1980 µm, 1990 µm, 2000 µm, 2010 µm, 2020 µm, 2030 µm, 2040 µm, 2050 µm, 2060 µm, 2070 µm, 2080 µm, 2090 µm, 2100 µm, 2110 µm, 2120 µm, 2130 µm, 2140 µm, 2150 µm, 2160 µm, 2170 µm, 2180 µm, 2190 µm, 2200 µm, 2210 µm, 2220 µm, 2230 µm, 2240 µm, 2250 µm, 2260 µm, 2270 µm, 2280 µm, 2290 µm, 2300 µm, 2310 µm, 2320 µm, 2330 µm, 2340 µm, 2350 µm, 2360 µm, 2370 µm, 2380 µm, 2390 µm, 2400 µm, 2410 µm, 2420 µm, 2430 µm, 2440 µm, 2450 µm, 2460 µm, 2470 µm, 2480 µm, 2490 µm, 2500 µm, 2510 µm, 2520 µm, 2530 µm, 2540 µm, 2550 µm, 2560 µm, 2570 µm, 2580 µm, 2590 µm, 2600 µm, 2610 µm, 2620 µm, 2630 µm, 2640 µm, 2650 µm, 2660 µm, 2670 µm, 2680 µm, 2690 µm, 2700 µm, 2710 µm, 2720 µm, 2730 µm, 2740 µm, 2750 µm, 2760 µm, 2770 µm, 2780 µm, 2790 µm, 2800 µm, 2810 µm, 2820 µm, 2830 µm, 2840 µm, 2850 µm, 2860 µm, 2870 µm, 2880 µm, 2890 µm, 2900 µm, 2910 µm, 2920 µm, 2930 µm, 2940 µm, 2950 µm, 2960 µm, 2970 µm, 2980 µm, 2990 µm, or 3000 µm thick.

In some embodiments, the microbial cells can be coated freely onto any number of compositions or they can be formulated in a liquid or solid composition before being coated onto a composition. For example, a solid composition comprising the microorganisms can be prepared by mixing a solid carrier with a suspension of the spores until the solid carriers are impregnated with the spore or cell suspension. This mixture can then be dried to obtain the desired particles.

In some other embodiments, it is contemplated that the solid or liquid microbial compositions of the present disclosure further contain functional agents e.g., activated carbon, minerals, vitamins, and other agents capable of improving the quality of the products or a combination thereof.

Methods of coating and compositions in use of said methods that are known in the art can be particularly useful when they are modified by the addition of one of the embodiments of the present disclosure. Such coating methods and apparatus for their application are disclosed in, for example: U.S. Pat. Nos. 8,097,245, and 7,998,502; and PCT Pat. App. Publication Nos. WO 2008/076975, WO 2010/138522, WO 2011/094469, WO 2010/111347, and WO 2010/111565 each of which is incorporated by reference herein.

In some embodiments, the microbes or microbial consortia of the present disclosure exhibit a synergistic effect, on one or more of the traits described herein, in the presence of one or more of the microbes or consortia coming into contact with one another. The synergistic effect obtained by the taught methods can be quantified, for example, according to Colby's formula (i.e., $(E)=X+Y-(X*Y/100)$). See Colby, R. S., "Calculating Synergistic and Antagonistic Responses of Herbicide Combinations," 1967. Weeds. Vol. 15, pp. 20-22, incorporated herein by reference in its entirety. Thus, "synergistic" is intended to reflect an outcome/parameter/effect that has been increased by more than an additive amount.

In some embodiments, the microbes or microbial consortia of the present disclosure may be administered via bolus. In one embodiment, a bolus (e.g., capsule containing the composition) is inserted into a bolus gun, and the bolus gun is inserted into the buccal cavity and/or esophagas of the animal, followed by the release/injection of the bolus into the animal's digestive tract. In one embodiment, the bolus gun/applicator is a BOVIKALC bolus gun/applicator. In another embodiment, the bolus gun/applicator is a QUADRICAL gun/applicator.

In some embodiments, the microbes or microbial consortia of the present disclosure may be administered via drench. In one embodiment, the drench is an oral drench. A drench administration comprises utilizing a drench kit/applicator/syringe that injects/releases a liquid comprising the microbes or microbial consortia into the buccal cavity and/or esophagas of the animal.

In some embodiments, the microbes or microbial consortia of the present disclosure may be administered in a time-released fashion. The composition may be coated in a chemical composition, or may be contained in a mechanical device or capsule that releases the microbes or microbial consortia over a period of time instead all at once. In one embodiment, the microbes or microbial consortia are administered to an animal in a time-release capsule. In one embodiment, the composition may be coated in a chemical composition, or may be contained in a mechanical device or capsul that releases the mcirobes or microbial consortia all at once a period of time hours post ingestion.

In some embodiments, the microbes or microbial consortia are administered in a time-released fashion between 1 to 5, 1 to 10, 1 to 15, 1 to 20, 1 to 24, 1 to 25, 1 to 30, 1 to 35, 1 to 40, 1 to 45, 1 to 50, 1 to 55, 1 to 60, 1 to 65, 1 to 70, 1 to 75, 1 to 80, 1 to 85, 1 to 90, 1 to 95, or 1 to 100 hours.

In some embodiments, the microbes or microbial consortia are administered in a time-released fashion between 1 to 2, 1 to 3, 1 to 4, 1 to 5, 1 to 6, 1 to 7, 1 to 8, 1 to 9, 1 to 10, 1 to 11, 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 29, or 1 to 30 days.

Microorganisms

As used herein the term "microorganism" should be taken broadly. It includes, but is not limited to, the two prokaryotic domains, Bacteria and Archaea, as well as eukaryotic fungi, protists, and viruses.

By way of example, the microorganisms may include species of the genera of: *Clostridium, Ruminococcus, Roseburia, Hydrogenoanaerobacterium, Saccharofermentans, Papillibacter, Pelotomaculum, Butyricicoccus, Tannerella, Prevotella, Butyricimonas, Piromyces, Pichia, Candida, Vrystaatia, Orpinomyces, Neocallimastix,* and *Phyllosticta*. The microorganisms may further include species belonging to the family of Lachnospiraceae, and the order of Saccharomycetales. In some embodiments, the microorganisms may include species of any genera disclosed herein.

In certain embodiments, the microorganism is unculturable. This should be taken to mean that the microorganism is not known to be culturable or is difficult to culture using methods known to one skilled in the art.

In one embodiment, the microbes are obtained from animals (e.g., mammals, reptiles, birds, and the like), soil (e.g., rhizosphere), air, water (e.g., marine, freshwater, wastewater sludge), sediment, oil, plants (e.g., roots, leaves, stems), agricultural products, and extreme environments (e.g., acid mine drainage or hydrothermal systems). In a further embodiment, microbes obtained from marine or freshwater environments such as an ocean, river, or lake. In a further embodiment, the microbes can be from the surface of the body of water, or any depth of the body of water (e.g., a deep sea sample).

The microorganisms of the disclosure may be isolated in substantially pure or mixed cultures. They may be concentrated, diluted, or provided in the natural concentrations in which they are found in the source material. For example, microorganisms from saline sediments may be isolated for use in this disclosure by suspending the sediment in fresh water and allowing the sediment to fall to the bottom. The water containing the bulk of the microorganisms may be removed by decantation after a suitable period of settling and either administered to the GI tract of an ungulate, or concentrated by filtering or centrifugation, diluted to an appropriate concentration and administered to the GI tract of an ungulate with the bulk of the salt removed. By way of further example, microorganisms from mineralized or toxic sources may be similarly treated to recover the microbes for application to the ungulate to minimize the potential for damage to the animal.

In another embodiment, the microorganisms are used in a crude form, in which they are not isolated from the source material in which they naturally reside. For example, the microorganisms are provided in combination with the source material in which they reside; for example, fecal matter, cud, or other composition found in the gastrointestinal tract. In this embodiment, the source material may include one or more species of microorganisms.

In some embodiments, a mixed population of microorganisms is used in the methods of the disclosure.

In embodiments of the disclosure where the microorganisms are isolated from a source material (for example, the material in which they naturally reside), any one or a combination of a number of standard techniques which will be readily known to skilled persons may be used. However, by way of example, these in general employ processes by which a solid or liquid culture of a single microorganism can be obtained in a substantially pure form, usually by physical separation on the surface of a solid microbial growth medium or by volumetric dilutive isolation into a liquid microbial growth medium. These processes may include isolation from dry material, liquid suspension, slurries or homogenates in which the material is spread in a thin layer over an appropriate solid gel growth medium, or serial dilutions of the material made into a sterile medium and inoculated into liquid or solid culture media.

Whilst not essential, in one embodiment, the material containing the microorganisms may be pre-treated prior to the isolation process in order to either multiply all microorganisms in the material. Microorganisms can then be isolated from the enriched materials as disclosed above.

In certain embodiments, as mentioned herein before, the microorganism(s) may be used in crude form and need not be isolated from an animal or a media. For example, cud, feces, or growth media which includes the microorganisms identified to be of benefit to increased milk production in ungulates may be obtained and used as a crude source of microorganisms for the next round of the method or as a crude source of microorganisms at the conclusion of the method. For example, fresh feces could be obtained and optionally processed.

Microbiome Shift and Abundance of Microbes

In some embodiments, the microbiome of a ruminant, including the rumen microbiome, comprises a diverse arrive of microbes with a wide variety of metabolic capabilities. The microbiome is influenced by a range of factors including diet, variations in animal metabolism, and breed, among others. Most bovine diets are plant-based and rich in complex polysaccharides that enrich the gastrointestinal microbial community for microbes capable of breaking down specific polymeric components in the diet. The end products of primary degradation sustains a chain of microbes that ultimately produce a range of organic acids together with hydrogen and carbon dioxide. Because of the complex and interlinked nature of the microbiome, changing the diet and thus substrates for primary degradation may have a cascading effect on rumen microbial metabolism, with changes in both the organic acid profiles and the methane levels produced, thus impacting the quality and quantity of animal production and or the products produced by the animal. See Menezes et al. (2011. *FEMS Microbiol. Ecol.* 78(2):256-265.)

In some aspects, the present disclosure is drawn to administering microbial compositions described herein to modulate or shift the microbiome of a ruminant.

In some embodiments, the microbiome is shifted through the administration of one or more microbes to the gastrointestinal tract. In further embodiments, the one or more microbes are those selected from Table 1 or Table 3. In some embodiments, the microbiome shift or modulation includes a decrease or loss of specific microbes that were present prior to the administration of one or more microbes of the present disclosure. In some embodiments, the microbiome shift or modulation includes an increase in microbes that were present prior to the administration of one or more microbes of the present disclosure. In some embodiments, the microbiome shift or modulation includes a gain of one or more microbes that were not present prior to the administration of one or more microbes of the present disclosure. In a further embodiment, the gain of one or more microbes is a microbe that was not specifically included in the administered microbial consortium.

In some embodiments, the administration of microbes of the present disclosure results in a sustained modulation of the microbiome such that the administered microbes are present in the microbiome for a period of at least 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 days.

In some embodiments, the administration of microbes of the present disclosure results in a sustained modulation of the microbiome such that the administered microbes are present in the microbiome for a period of at least 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, or 10 weeks.

In some embodiments, the administration of microbes of the present disclosure results in a sustained modulation of the microbiome such that the administered microbes are present in the microbiome for a period of at least 1 to 10, 1 to 9, 1 to 8, 1 to 7, 1 to 6, 1 to 5, 1 to 4, 1 to 3, 1 to 2, 2 to 10, 2 to 9, 2 to 8, 2 to 7, 2 to 6, 2 to 5, 2 to 4, 2 to 3, 3 to 10, 3 to 9, 3 to 8, 3 to 7, 3 to 6, 3 to 5, 3 to 4, 4 to 10, 4 to 9, 4 to 8, 4 to 7, 4 to 6, 4 to 5, 5 to 10, 5 to 9, 5 to 8, 5 to 7, 5 to 6, 6 to 10, 6 to 9, 6 to 8, 6 to 7, 7 to 10, 7 to 9, 7 to 8, 8 to 10, 8 to 9, 9 to 10, 1, 2, 3, 4, 5, 6, 7, 8, 9, 10, 11, or 12 months.

In some embodiments, the presence of the administered microbes are detected by sampling the gastrointestinal tract and using primers to amplify the 16S or 18S rDNA sequences, or the ITS rDNA sequences of the administered microbes. In some embodiments, the administered microbes are one or more of those selected from Table 1 or Table 3, and the corresponding rDNA sequences are those selected from SEQ ID NOs:1-60, SEQ ID NOs:2045-2107 and the SEQ ID NOs identified in Table 3.

In some embodiments, the microbiome of a ruminant is measured by amplifying polynucleotides collected from gastrointestinal samples, wherein the polynucleotides may be 16S or 18S rDNA fragments, or ITS rDNA fragments of microbial rDNA. In one embodiment, the microbiome is fingerprinted by a method of denaturing gradient gel electrophoresis (DGGE) wherein the amplified rDNA fragments are sorted by where they denature, and form a unique banding pattern in a gel that may be used for comparing the microbiome of the same ruminant over time or the microbiomes of multiple ruminants. In another embodiment, the microbiome is fingerprinted by a method of terminal restriction fragment length polymorphism (T-RFLP), wherein labelled PCR fragments are digested using a restriction enzyme and then sorted by size. In a further embodiment, the data collected from the T-RFLP method is evaluated by nonmetric multidimensional scaling (nMDS) ordination and PERMANOVA statistics identify differences in microbiomes, thus allowing for the identification and measurement of shifts in the microbiome. See also Shanks et al. (2011. *Appl. Environ. Microbiol.* 77(9):2992-3001), Petri et al. (2013. *PLOS one.* 8(12):e83424), and Menezes et al. (2011. *FEMS Microbiol. Ecol.* 78(2):256-265.)

In some embodiments, the administration of microbes of the present disclosure results in a modulation or shift of the microbiome which further results in a desired phenotype or improved trait.

Figure 2:
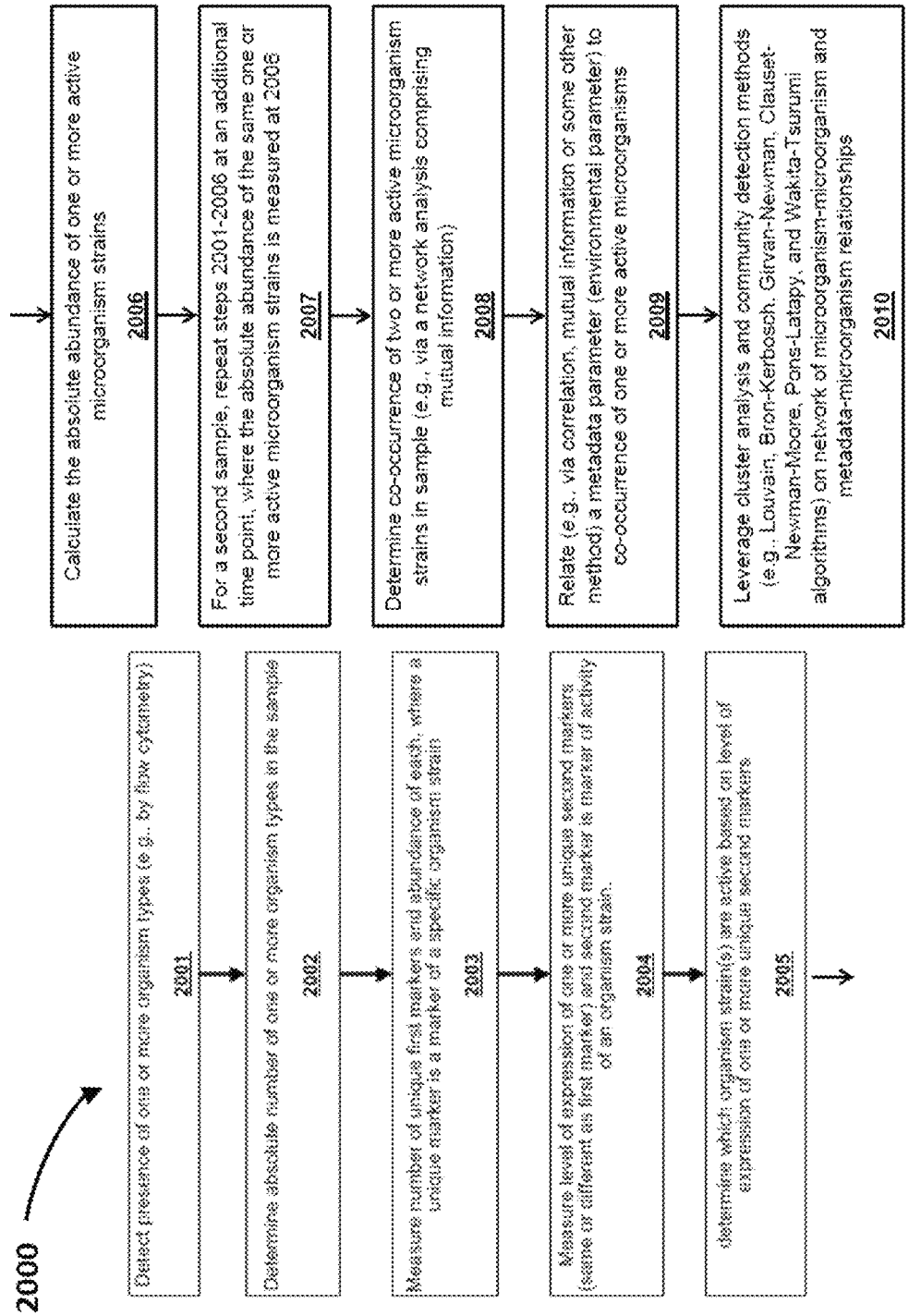
FIG. 2 shows a general workflow of one embodiment of a method for determining the co-occurrence of one or more, or two or more, active microorganism strains in a sample with one or more metadata (environmental) parameters, followed by leveraging cluster analysis and community detection methods on the network of determined relationships.

According to the methods provided herein, a sample is processed to detect the presence of one or more microorganism types in the sample (FIG. 1, 1001; FIG. 2, 2001). The absolute number of one or more microorganism organism type in the sample is determined (FIG. 1, 1002; FIG. 2, 2002). The determination of the presence of the one or more organism types and the absolute number of at least one organism type can be conducted in parallel or serially. For example, in the case of a sample comprising a microbial community comprising bacteria (i.e., one microorganism type) and fungi (i.e., a second microorganism type), the user in one embodiment detects the presence of one or both of the organism types in the sample (FIG. 1, 1001; FIG. 2, 2001). The user, in a further embodiment, determines the absolute number of at least one organism type in the sample—in the case of this example, the number of bacteria, fungi or combination thereof, in the sample (FIG. 1, 1002; FIG. 2, 2002).

In one embodiment, the sample, or a portion thereof is subjected to flow cytometry (FC) analysis to detect the presence and/or number of one or more microorganism types (FIG. 1, 1001, 1002; FIG. 2, 2001, 2002). In one flow cytometer embodiment, individual microbial cells pass through an illumination zone, at a rate of at least about $300*s^{-1}$, or at least about $500*s^{-1}$, or at least about $1000*s^{-1}$. However, one of ordinary skill in the art will recognize that this rate can vary depending on the type of instrument is employed. Detectors which are gated electronically measure the magnitude of a pulse representing the extent of light scattered. The magnitudes of these pulses are sorted electronically into "bins" or "channels," permitting the display of histograms of the number of cells possessing a certain quantitative property (e.g., cell staining property, diameter, cell membrane) versus the channel number. Such analysis allows for the determination of the number of cells in each "bin" which in embodiments described herein is an "microorganism type" bin, e.g., a bacteria, fungi, nematode, protozoan, archaea, algae, dinoflagellate, virus, viroid, etc.

In one embodiment, a sample is stained with one or more fluorescent dyes wherein a fluorescent dye is specific to a particular microorganism type, to enable detection via a flow cytometer or some other detection and quantification method that harnesses fluorescence, such as fluorescence microscopy. The method can provide quantification of the number of cells and/or cell volume of a given organism type in a sample. In a further embodiment, as described herein, flow cytometry is harnessed to determine the presence and quantity of a unique first marker and/or unique second marker of the organism type, such as enzyme expression, cell surface protein expression, etc. Two- or three-variable histograms or contour plots of, for example, light scattering versus fluorescence from a cell membrane stain (versus fluorescence from a protein stain or DNA stain) may also be generated, and thus an impression may be gained of the distribution of a variety of properties of interest among the cells in the population as a whole. A number of displays of such multiparameter flow cytometric data are in common use and are amenable for use with the methods described herein.

In one embodiment of processing the sample to detect the presence and number of one or more microorganism types, a microscopy assay is employed (FIG. 1, 1001, 1002). In one embodiment, the microscopy is optical microscopy, where visible light and a system of lenses are used to magnify images of small samples. Digital images can be captured by a charge-couple device (CCD) camera. Other microscopic techniques include, but are not limited to, scanning electron microscopy and transmission electron microscopy. Microorganism types are visualized and quantified according to the aspects provided herein.

In another embodiment of in order to detect the presence and number of one or more microorganism types, the sample, or a portion thereof is subjected to fluorescence microscopy. Different fluorescent dyes can be used to directly stain cells in samples and to quantify total cell counts using an epifluorescence microscope as well as flow cytometry, described above. Useful dyes to quantify microorganisms include but are not limited to acridine orange (AO), 4,6-di-amino-2 phenylindole (DAPI) and 5-cyano-2,3 Dytolyl Tetrazolium Chloride (CTC). Viable cells can be estimated by a viability staining method such as the LIVE/DEAD® Bacterial Viability Kit (Bac-Light™) which contains two nucleic acid stains: the green-fluorescent SYTO 9™ dye penetrates all membranes and the red-fluorescent propidium iodide (PI) dye penetrates cells with damaged membranes. Therefore, cells with compromised membranes will stain red, whereas cells with undamaged membranes will stain green. Fluorescent in situ hybridization (FISH) extends epifluorescence microscopy, allowing for the fast detection and enumeration of specific organisms. FISH uses fluorescent labelled oligonucleotides probes (usually 15-25 basepairs) which bind specifically to organism DNA in the sample, allowing the visualization of the cells using an epifluorescence or confocal laser scanning microscope (CLSM). Catalyzed reporter deposition fluorescence in situ hybridization (CARD-FISH) improves upon the FISH method by using oligonucleotide probes labelled with a horse radish peroxidase (HRP) to amplify the intensity of the signal obtained from the microorganisms being studied. FISH can be combined with other techniques to characterize microorganism communities. One combined technique is high affinity peptide nucleic acid (PNA)-FISH, where the probe has an enhanced capability to penetrate through the Extracellular Polymeric Substance (EPS) matrix. Another example is LIVE/DEAD-FISH which combines the cell viability kit with FISH and has been used to assess the efficiency of disinfection in drinking water distribution systems.

In another embodiment, the sample, or a portion thereof is subjected to Raman micro-spectroscopy in order to determine the presence of a microorganism type and the absolute number of at least one microorganism type (FIG. 1, 1001-1002; FIG. 2, 2001-2002). Raman micro-spectroscopy is a non-destructive and label-free technology capable of detecting and measuring a single cell Raman spectrum (SCRS). A typical SCRS provides an intrinsic biochemical "fingerprint" of a single cell. A SCRS contains rich information of the biomolecules within it, including nucleic acids, proteins, carbohydrates and lipids, which enables characterization of different cell species, physiological changes and cell phenotypes. Raman microscopy examines the scattering of laser light by the chemical bonds of different cell biomarkers. A SCRS is a sum of the spectra of all the biomolecules in one single cell, indicating a cell's phenotypic profile. Cellular phenotypes, as a consequence of gene expression, usually reflect genotypes. Thus, under identical growth conditions, different microorganism types give distinct SCRS corresponding to differences in their genotypes and can thus be identified by their Raman spectra.

In yet another embodiment, the sample, or a portion thereof is subjected to centrifugation in order to determine the presence of a microorganism type and the number of at least one microorganism type (FIG. 1, 1001-1002; FIG. 2, 2001-2002). This process sediments a heterogeneous mixture by using the centrifugal force created by a centrifuge. More dense components of the mixture migrate away from the axis of the centrifuge, while less dense components of the mixture migrate towards the axis. Centrifugation can allow fractionation of samples into cytoplasmic, membrane and extracellular portions. It can also be used to determine localization information for biological molecules of interest. Additionally, centrifugation can be used to fractionate total microbial community DNA. Different prokaryotic groups differ in their guanine-plus-cytosine (G+C) content of DNA, so density-gradient centrifugation based on G+C content is a method to differentiate organism types and the number of cells associated with each type. The technique generates a fractionated profile of the entire community DNA and indicates abundance of DNA as a function of G+C content. The total community DNA is physically separated into highly purified fractions, each representing a different G+C content that can be analyzed by additional molecular techniques such as denaturing gradient gel electrophoresis (DGGE)/amplified ribosomal DNA restriction analysis (AR-DRA) (see discussion herein) to assess total microbial community diversity and the presence/quantity of one or more microorganism types.

In another embodiment, the sample, or a portion thereof is subjected to staining in order to determine the presence of a microorganism type and the number of at least one microorganism type (FIG. 1, 1001-1002; FIG. 2, 2001-2002). Stains and dyes can be used to visualize biological tissues, cells or organelles within cells. Staining can be used in conjunction with microscopy, flow cytometry or gel electrophoresis to visualize or mark cells or biological molecules that are unique to different microorganism types. In vivo staining is the process of dyeing living tissues, whereas in vitro staining involves dyeing cells or structures that have been removed from their biological context. Examples of specific staining techniques for use with the methods described herein include, but are not limited to: gram staining to determine gram status of bacteria, endospore staining to identify the presence of endospores, Ziehl-Neelsen staining, haematoxylin and eosin staining to examine thin sections of tissue, papanicolaou staining to examine cell samples from various bodily secretions, periodic acid-Schiff staining of carbohydrates, Masson's trichome employing a three-color staining protocol to distinguish cells from the surrounding connective tissue, Romanowsky stains (or common variants that include Wright's stain, Jenner's stain, May-Grunwald stain, Leishman stain and Giemsa stain) to examine blood or bone marrow samples, silver staining to reveal proteins and DNA, Sudan staining for lipids and Conklin's staining to detect true endospores. Common biological stains include acridine orange for cell cycle determination; bismarck brown for acid mucins; carmine for glycogen; carmine alum for nuclei; Coomassie blue for proteins; Cresyl violet for the acidic components of the neuronal cytoplasm; Crystal violet for cell walls; DAPI for nuclei; eosin for cytoplasmic material, cell membranes, some extracellular structures and red blood cells; ethidium bromide for DNA; acid fuchsine for collagen, smooth muscle or mitochondria; haematoxylin for nuclei; Hoechst stains for DNA; iodine for starch; malachite green for bacteria in the Gimenez staining technique and for spores; methyl green for chromatin; methylene blue for animal cells; neutral red for Nissl substance; Nile blue for nuclei; Nile red for lipohilic entities; osmium tetroxide for lipids; rhodamine is used in fluorescence microscopy; safranin for nuclei. Stains are also used in transmission electron microscopy to enhance contrast and include phosphotungstic acid, osmium tetroxide, ruthenium tetroxide, ammonium molybdate, cadmium iodide, carbohydrazide, ferric chloride, hexamine, indium trichloride, lanthanum nitrate, lead acetate, lead citrate, lead(II) nitrate, periodic acid, phosphomolybdic acid, potassium ferricyanide, potassium ferrocyanide, ruthenium red, silver nitrate, silver proteinate, sodium chloroaurate, thallium nitrate, thiosemicarbazide, uranyl acetate, uranyl nitrate, and vanadyl sulfate.

In another embodiment, the sample, or a portion thereof is subjected to mass spectrometry (MS) in order to determine the presence of a microorganism type and the number of at least one microorganism type (FIG. 1, 1001-1002; FIG. 2, 2001-2002). MS, as discussed below, can also be used to detect the presence and expression of one or more unique markers in a sample (FIG. 1, 1003-1004; FIG. 2, 2003-2004). MS is used for example, to detect the presence and quantity of protein and/or peptide markers unique to microorganism types and therefore to provide an assessment of the number of the respective microorganism type in the sample. Quantification can be either with stable isotope labelling or label-free. De novo sequencing of peptides can also occur directly from MS/MS spectra or sequence tagging (produce a short tag that can be matched against a database). MS can also reveal post-translational modifications of proteins and identify metabolites. MS can be used in conjunction with chromatographic and other separation techniques (such as gas chromatography, liquid chromatography, capillary electrophoresis, ion mobility) to enhance mass resolution and determination.

In another embodiment, the sample, or a portion thereof is subjected to lipid analysis in order to determine the presence of a microorganism type and the number of at least one microorganism type (FIG. 1, 1001-1002; FIG. 2, 2001-2002). Fatty acids are present in a relatively constant proportion of the cell biomass, and signature fatty acids exist in microbial cells that can differentiate microorganism types within a community. In one embodiment, fatty acids are extracted by saponification followed by derivatization to give the respective fatty acid methyl esters (FAMEs), which are then analyzed by gas chromatography. The FAME profile in one embodiment is then compared to a reference FAME database to identify the fatty acids and their corresponding microbial signatures by multivariate statistical analyses.

In the aspects of the methods provided herein, the number of unique first makers in the sample, or portion thereof (e.g., sample aliquot) is measured, as well as the abundance of each of the unique first markers (FIG. 1, 1003; FIG. 2, 2003).

A unique marker is a marker of a microorganism strain. It should be understood by one of ordinary skill in the art that depending on the unique marker being probed for and measured, the entire sample need not be analyzed. For example, if the unique marker is unique to bacterial strains, then the fungal portion of the sample need not be analyzed. As described above, in some embodiments, measuring the absolute abundance of one or more organism types in a sample comprises separating the sample by organism type, e.g., via flow cytometry.

Any marker that is unique to an organism strain can be employed herein. For example, markers can include, but are not limited to, small subunit ribosomal RNA genes (16S/18S rDNA), large subunit ribosomal RNA genes (23S/25S/28S rDNA), intercalary 5.8S gene, cytochrome c oxidase, beta-tubulin, elongation factor, RNA polymerase and internal transcribed spacer (ITS).

Ribosomal RNA genes (rDNA), especially the small subunit ribosomal RNA genes, i.e., 18S rRNA genes (18S rDNA) in the case of eukaryotes and 16S rRNA (16S rDNA) in the case of prokaryotes, have been the predominant target for the assessment of organism types and strains in a microbial community. However, the large subunit ribosomal RNA genes, 28S rDNAs, have been also targeted. rDNAs are suitable for taxonomic identification because: (i) they are ubiquitous in all known organisms; (ii) they possess both conserved and variable regions; (iii) there is an exponentially expanding database of their sequences available for comparison. In community analysis of samples, the conserved regions serve as annealing sites for the corresponding universal PCR and/or sequencing primers, whereas the variable regions can be used for phylogenetic differentiation. In addition, the high copy number of rDNA in the cells facilitates detection from environmental samples.

The internal transcribed spacer (ITS), located between the 18S rDNA and 28S rDNA, has also been targeted. The ITS is transcribed but spliced away before assembly of the ribosomes The ITS region is composed of two highly variable spacers, ITS1 and ITS2, and the intercalary 5.8S gene. This rDNA operon occurs in multiple copies in genomes. Because the ITS region does not code for ribosome components, it is highly variable.

In one embodiment, the unique RNA marker can be an mRNA marker, an siRNA marker or a ribosomal RNA marker.

Protein-coding functional genes can also be used herein as a unique first marker. Such markers include but are not limited to: the recombinase A gene family (bacterial RecA, archaea RadA and RadB, eukaryotic Rad51 and Rad57, phage UvsX); RNA polymerase β subunit (RpoB) gene, which is responsible for transcription initiation and elongation; chaperonins. Candidate marker genes have also been identified for bacteria plus archaea: ribosomal protein S2 (rpsB), ribosomal protein S10 (rpsJ), ribosomal protein L1 rplA), translation elongation factor EF-2, translation initiation factor IF-2, metalloendopeptidase, ribosomal protein L22, ffh signal recognition particle protein, ribosomal protein L4/Lle (rplD), ribosomal protein L2 (rplB), ribosomal protein S9 (rpsI), ribosomal protein L3 (rplC), phenylalanyl-tRNA synthetase beta subunit, ribosomal protein L14b/L23e (rplN), ribosomal protein S5, ribosomal protein S19 (rpsS), ribosomal protein S7, ribosomal protein L16/L10E (rplP), ribosomal protein S13 (rpsM), phenylalanyl-tRNA synthetase α subunit, ribosomal protein L15, ribosomal protein L25/L23, ribosomal protein L6 (rplF), ribosomal protein L11 (rplK), ribosomal protein L5 (rplE), ribosomal protein S12/S23, ribosomal protein L29, ribosomal protein S3 (rpsC), ribosomal protein S11 (rpsK), ribosomal protein L10, ribosomal protein S8, tRNA pseudouridine synthase B, ribosomal protein L18P/L5E, ribosomal protein S15P/S13e, Porphobilinogen deaminase, ribosomal protein S17, ribosomal protein L13 (rplM), phosphoribosylformylglycinamidine cyclo-ligase (rpsE), ribonuclease HII and ribosomal protein L24. Other candidate marker genes for bacteria include: transcription elongation protein NusA (nusA), rpoB DNA-directed RNA polymerase subunit beta (rpoB), GTP-binding protein EngA, rpoC DNA-directed RNA polymerase subunit beta', priA primosome assembly protein, transcription-repair coupling factor, CTP synthase (pyrG), secY preprotein translocase subunit SecY, GTP-binding protein Obg/CgtA, DNA polymerase I, rpsF 30S ribosomal protein S6, poA DNA-directed RNA polymerase subunit alpha, peptide chain release factor 1, rplI 50S ribosomal protein L9, polyribonucleotide nucleotidyltransferase, tsf elongation factor Ts (tsf), rplQ 50S ribosomal protein L17, tRNA (guanine-N(1)-)-methyltransferase (rplS), rplY probable 50S ribosomal protein L25, DNA repair protein RadA, glucose-inhibited division protein A, ribosome-binding factor A, DNA mismatch repair protein MutL, smpB SsrA-binding protein (smpB), N-acetylglucosaminyl transferase, S-adenosyl-methyltransferase MraW, UDP-N-acetylmuramoylalanine-D-glutamate ligase, rplS 50S ribosomal protein L19, rp1T 50S ribosomal protein L20 (rplT), ruvA Holliday junction DNA helicase, ruvB Holliday junction DNA helicase B, serS seryl-tRNA synthetase, rplU 50S ribosomal protein L21, rpsR 30S ribosomal protein S18, DNA mismatch repair protein MutS, rpsT 30S ribosomal protein S20, DNA repair protein RecN, frr ribosome recycling factor (frr), recombination protein RecR, protein of unknown function UPF0054, miaA tRNA isopentenyltransferase, GTP-binding protein YchF, chromosomal replication initiator protein DnaA, dephospho-CoA kinase, 16S rRNA processing protein RimM, ATP-cone domain protein, 1-deoxy-D-xylulose 5-phosphate reductoisomerase, 2C-methyl-D-erythritol 2,4-cyclodiphosphate synthase, fatty acid/phospholipid synthesis protein PlsX, tRNA(Ile)-lysidine synthetase, dnaG DNA primase (dnaG), ruvC Holliday junction resolvase, rpsP 30S ribosomal protein S16, Recombinase A recA, riboflavin biosynthesis protein RibF, glycyl-tRNA synthetase beta subunit, trmU tRNA (5-methylaminomethyl-2-thiouridylate)-methyltransferase, rpmI 50S ribosomal protein L35, hemE uroporphyrinogen decarboxylase, Rod shape-determining protein, rpmA 50S ribosomal protein L27 (rpmA), peptidyl-tRNA hydrolase, translation initiation factor IF-3 (infC), UDP-N-acetylmuramyl-tripeptide synthetase, rpmF 50S ribosomal protein L32, rpIL 50S ribosomal protein L7/L12 (rpIL), leuS leucyl-tRNA synthetase, ligA NAD-dependent DNA ligase, cell division protein FtsA, GTP-binding protein TypA, ATP-dependent Clp protease, ATP-binding subunit ClpX, DNA replication and repair protein RecF and UDP-N-acetylenolpyruvoylglucosamine reductase.

Phospholipid fatty acids (PLFAs) may also be used as unique first markers according to the methods described herein. Because PLFAs are rapidly synthesized during microbial growth, are not found in storage molecules and degrade rapidly during cell death, it provides an accurate census of the current living community. All cells contain fatty acids (FAs) that can be extracted and esterified to form fatty acid methyl esters (FAMEs). When the FAMEs are analyzed using gas chromatography—mass spectrometry, the resulting profile constitutes a 'fingerprint' of the microorganisms in the sample. The chemical compositions of membranes for organisms in the domains Bacteria and Eukarya are comprised of fatty acids linked to the glycerol by an ester-type bond (phospholipid fatty acids (PLFAs)). In contrast, the membrane lipids of Archaea are composed of long and branched hydrocarbons that are joined to glycerol by an ether-type bond (phospholipid ether lipids (PLELs)). This is one of the most widely used non-genetic criteria to distinguish the three domains. In this context, the phospholipids derived from microbial cell membranes, characterized by different acyl chains, are excellent signature molecules, because such lipid structural diversity can be linked to specific microbial taxa.

As provided herein, in order to determine whether an organism strain is active, the level of expression of one or more unique second markers, which can be the same or different as the first marker, is measured (FIG. 1, 1004; FIG. 2, 2004). Unique first unique markers are described above. The unique second marker is a marker of microorganism activity. For example, in one embodiment, the mRNA or protein expression of any of the first markers described above is considered a unique second marker for the purposes of this invention.

In one embodiment, if the level of expression of the second marker is above a threshold level (e.g., a control level) or at a threshold level, the microorganism is considered to be active (FIG. 1, 1005; FIG. 2, 2005). Activity is determined in one embodiment, if the level of expression of the second marker is altered by at least about 5%, at least about 10%, at least about 15%, at least about 20%, at least about 25%, or at least about 30%, as compared to a threshold level, which in some embodiments, is a control level.

Second unique markers are measured, in one embodiment, at the protein, RNA or metabolite level. A unique second marker is the same or different as the first unique marker.

As provided above, a number of unique first markers and unique second markers can be detected according to the methods described herein. Moreover, the detection and quantification of a unique first marker is carried out according to methods known to those of ordinary skill in the art (FIG. 1, 1003-1004, FIG. 2, 2003-2004).

Nucleic acid sequencing (e.g., gDNA, cDNA, rRNA, mRNA) in one embodiment is used to determine absolute abundance of a unique first marker and/or unique second marker. Sequencing platforms include, but are not limited to, Sanger sequencing and high-throughput sequencing methods available from Roche/454 Life Sciences, Illumina/Solexa, Pacific Biosciences, Ion Torrent and Nanopore. The sequencing can be amplicon sequencing of particular DNA or RNA sequences or whole metagenome/transcriptome shotgun sequencing.

Traditional Sanger sequencing (Sanger et al. (1977) DNA sequencing with chain-terminating inhibitors. Proc Natl. Acad. Sci. USA, 74, pp. 5463-5467, incorporated by reference herein in its entirety) relies on the selective incorporation of chain-terminating dideoxynucleotides by DNA polymerase during in vitro DNA replication and is amenable for use with the methods described herein.

In another embodiment, the sample, or a portion thereof is subjected to extraction of nucleic acids, amplification of DNA of interest (such as the rRNA gene) with suitable primers and the construction of clone libraries using sequencing vectors. Selected clones are then sequenced by Sanger sequencing and the nucleotide sequence of the DNA of interest is retrieved, allowing calculation of the number of unique microorganism strains in a sample.

454 pyrosequencing from Roche/454 Life Sciences yields long reads and can be harnessed in the methods described herein (Margulies et al. (2005) Nature, 437, pp. 376-380; U.S. Pat. Nos. 6,274,320; 6,258,568; 6,210,891, each of which is herein incorporated in its entirety for all purposes). Nucleic acid to be sequenced (e.g., amplicons or nebulized genomic/metagenomic DNA) have specific adapters affixed on either end by PCR or by ligation. The DNA with adapters is fixed to tiny beads (ideally, one bead will have one DNA fragment) that are suspended in a water-in-oil emulsion. An emulsion PCR step is then performed to make multiple copies of each DNA fragment, resulting in a set of beads in which each bead contains many cloned copies of the same DNA fragment. Each bead is then placed into a well of a fiber-optic chip that also contains enzymes necessary for the sequencing-by-synthesis reactions. The addition of bases (such as A, C, G, or T) trigger pyrophosphate release, which produces flashes of light that are recorded to infer the sequence of the DNA fragments in each well. About 1 million reads per run with reads up to 1,000 bases in length can be achieved. Paired-end sequencing can be done, which produces pairs of reads, each of which begins at one end of a given DNA fragment. A molecular barcode can be created and placed between the adapter sequence and the sequence of interest in multiplex reactions, allowing each sequence to be assigned to a sample bioinformatically.

Illumina/Solexa sequencing produces average read lengths of about 25 basepairs (bp) to about 300 bp (Bennett et al. (2005) Pharmacogenomics, 6:373-382; Lange et al. (2014). BMC Genomics 15, p. 63; Fadrosh et al. (2014) Microbiome 2, p. 6; Caporaso et al. (2012) ISME J, 6, p. 1621-1624; Bentley et al. (2008) Accurate whole human genome sequencing using reversible terminator chemistry. Nature, 456:53-59). This sequencing technology is also sequencing-by-synthesis but employs reversible dye terminators and a flow cell with a field of oligos attached. DNA fragments to be sequenced have specific adapters on either end and are washed over a flow cell filled with specific oligonucleotides that hybridize to the ends of the fragments. Each fragment is then replicated to make a cluster of identical fragments. Reversible dye-terminator nucleotides are then washed over the flow cell and given time to attach.

The excess nucleotides are washed away, the flow cell is imaged, and the reversible terminators can be removed so that the process can repeat and nucleotides can continue to be added in subsequent cycles. Paired-end reads that are 300 bases in length each can be achieved. An Illumina platform can produce 4 billion fragments in a paired-end fashion with 125 bases for each read in a single run. Barcodes can also be used for sample multiplexing, but indexing primers are used.

The SOLiD (Sequencing by Oligonucleotide Ligation and Detection, Life Technologies) process is a "sequencing-by-ligation" approach, and can be used with the methods described herein for detecting the presence and abundance of a first marker and/or a second marker (FIG. 1, 1003-1004; FIG. 2, 2003-2004) (Peckham et al. SOLiD™ Sequencing and 2-Base Encoding. San Diego, Calif.: American Society of Human Genetics, 2007; Mitra et al. (2013) Analysis of the intestinal microbiota using SOLiD 16S rRNA gene sequencing and SOLiD shotgun sequencing. BMC Genomics, 14(Suppl 5): S16; Mardis (2008) Next-generation DNA sequencing methods. Annu Rev Genomics Hum Genet, 9:387-402; each incorporated by reference herein in its entirety). A library of DNA fragments is prepared from the sample to be sequenced, and are used to prepare clonal bead populations, where only one species of fragment will be present on the surface of each magnetic bead. The fragments attached to the magnetic beads will have a universal P1 adapter sequence so that the starting sequence of every fragment is both known and identical. Primers hybridize to the P1 adapter sequence within the library template. A set of four fluorescently labelled di-base probes compete for ligation to the sequencing primer. Specificity of the di-base probe is achieved by interrogating every 1st and 2nd base in each ligation reaction. Multiple cycles of ligation, detection and cleavage are performed with the number of cycles determining the eventual read length. The SOLiD platform can produce up to 3 billion reads per run with reads that are 75 bases long. Paired-end sequencing is available and can be used herein, but with the second read in the pair being only 35 bases long. Multiplexing of samples is possible through a system akin to the one used by Illumina, with a separate indexing run.

The Ion Torrent system, like 454 sequencing, is amenable for use with the methods described herein for detecting the presence and abundance of a first marker and/or a second marker (FIG. 1, 1003-1004; FIG. 2, 2003-2004). It uses a plate of microwells containing beads to which DNA fragments are attached. It differs from all of the other systems, however, in the manner in which base incorporation is detected. When a base is added to a growing DNA strand, a proton is released, which slightly alters the surrounding pH. Microdetectors sensitive to pH are associated with the wells on the plate, and they record when these changes occur. The different bases (A, C, G, T) are washed sequentially through the wells, allowing the sequence from each well to be inferred. The Ion Proton platform can produce up to 50 million reads per run that have read lengths of 200 bases. The Personal Genome Machine platform has longer reads at 400 bases. Bidirectional sequencing is available. Multiplexing is possible through the standard in-line molecular barcode sequencing.

Pacific Biosciences (PacBio) SMRT sequencing uses a single-molecule, real-time sequencing approach and in one embodiment, is used with the methods described herein for detecting the presence and abundance of a first marker and/or a second marker (FIG. 1, 1003-1004; FIG. 2, 2003-2004). The PacBio sequencing system involves no amplification step, setting it apart from the other major next-generation sequencing systems. In one embodiment, the sequencing is performed on a chip containing many zero-mode waveguide (ZMW) detectors. DNA polymerases are attached to the ZMW detectors and phospholinked dye-labeled nucleotide incorporation is imaged in real time as DNA strands are synthesized. The PacBio system yields very long read lengths (averaging around 4,600 bases) and a very high number of reads per run (about 47,000). The typical "paired-end" approach is not used with PacBio, since reads are typically long enough that fragments, through CCS, can be covered multiple times without having to sequence from each end independently. Multiplexing with PacBio does not involve an independent read, but rather follows the standard "in-line" barcoding model.

In one embodiment, where the first unique marker is the ITS genomic region, automated ribosomal intergenic spacer analysis (ARISA) is used in one embodiment to determine the number and identity of microorganism strains in a sample (FIG. 1, 1003, FIG. 2, 2003) (Ranjard et al. (2003). Environmental Microbiology 5, pp. 1111-1120, incorporated by reference in its entirety for all puposes). The ITS region has significant heterogeneity in both length and nucleotide sequence. The use of a fluorescence-labeled forward primer and an automatic DNA sequencer permits high resolution of separation and high throughput. The inclusion of an internal standard in each sample provides accuracy in sizing general fragments.

In another embodiment, fragment length polymorphism (RFLP) of PCR-amplified rDNA fragments, otherwise known as amplified ribosomal DNA restriction analysis (ARDRA), is used to characterize unique first markers and the abundance of the same in samples (FIG. 1, 1003, FIG. 2, 2003) (Massol-Deya et al. (1995). Mol. Microb. Ecol. Manual. 3.3.2, pp. 1-18, incorporated by reference in its entirety for all puposes). rDNA fragments are generated by PCR using general primers, digested with restriction enzymes, electrophoresed in agarose or acrylamide gels, and stained with ethidium bromide or silver nitrate.

One fingerprinting technique used in detecting the presence and abundance of a unique first marker is single-stranded-conformation polymorphism (SSCP) (Lee et al. (1996). Appl Environ Microbiol 62, pp. 3112-3120; Scheinert et al. (1996). J. Microbiol. Methods 26, pp. 103-117; Schwieger and Tebbe (1998). Appl. Environ. Microbiol. 64, pp. 4870-4876, each of which is incorporated by reference herein in its entirety). In this technique, DNA fragments such as PCR products obtained with primers specific for the 16S rRNA gene, are denatured and directly electrophoresed on a non-denaturing gel. Separation is based on differences in size and in the folded conformation of single-stranded DNA, which influences the electrophoretic mobility. Reannealing of DNA strands during electrophoresis can be prevented by a number of strategies, including the use of one phosphorylated primer in the PCR followed by specific digestion of the phosphorylated strands with lambda exonuclease and the use of one biotinylated primer to perform magnetic separation of one single strand after denaturation. To assess the identity of the predominant populations in a given consortium, in one embodiment, bands are excised and sequenced, or SSCP-patterns can be hybridized with specific probes. Electrophoretic conditions, such as gel matrix, temperature, and addition of glycerol to the gel, can influence the separation.

In addition to sequencing based methods, other methods for quantifying expression (e.g., gene, protein expression) of a second marker are amenable for use with the methods provided herein for determining the level of expression of one or more second markers (FIG. 1, 1004; FIG. 2, 2004). For example, quantitative RT-PCR, microarray analysis, linear amplification techniques such as nucleic acid sequence based amplification (NASBA) are all amenable for use with the methods described herein, and can be carried out according to methods known to those of ordinary skill in the art.

In another embodiment, the sample, or a portion thereof is subjected to a quantitative polymerase chain reaction (PCR) for detecting the presence and abundance of a first marker and/or a second marker (FIG. 1, 1003-1004; FIG. 2, 2003-2004). Specific microorganism strains activity is measured by reverse transcription of transcribed ribosomal and/or messenger RNA (rRNA and mRNA) into complementary DNA (cDNA), followed by PCR (RT-PCR).

In another embodiment, the sample, or a portion thereof is subjected to PCR-based fingerprinting techniques to detect the presence and abundance of a first marker and/or a second marker (FIG. 1, 1003-1004; FIG. 2, 2003-2004). PCR products can be separated by electrophoresis based on the nucleotide composition. Sequence variation among the different DNA molecules influences the melting behaviour, and therefore molecules with different sequences will stop migrating at different positions in the gel. Thus electrophoretic profiles can be defined by the position and the relative intensity of different bands or peaks and can be translated to numerical data for calculation of diversity indices. Bands can also be excised from the gel and subsequently sequenced to reveal the phylogenetic affiliation of the community members. Electrophoresis methods include, but are not limited to: denaturing gradient gel electrophoresis (DGGE), temperature gradient gel electrophoresis (TGGE), single-stranded-conformation polymorphism (SSCP), restriction fragment length polymorphism analysis (RFLP) or amplified ribosomal DNA restriction analysis (ARDRA), terminal restriction fragment length polymorphism analysis (T-RFLP), automated ribosomal intergenic spacer analysis (ARISA), randomly amplified polymorphic DNA (RAPD), DNA amplification fingerprinting (DAF) and Bb-PEG electrophoresis.

In another embodiment, the sample, or a portion thereof is subjected to a chip-based platform such as microarray or microfluidics to determine the abundance of a unique first marker and/or presence/abundance of a unique second marker (FIG. 1, 1003-1004, FIG. 2, 2003-2004). The PCR products are amplified from total DNA in the sample and directly hybridized to known molecular probes affixed to microarrays. After the fluorescently labeled PCR amplicons are hybridized to the probes, positive signals are scored by the use of confocal laser scanning microscopy. The microarray technique allows samples to be rapidly evaluated with replication, which is a significant advantage in microbial community analyses. In general, the hybridization signal intensity on microarrays is directly proportional to the abundance of the target organism. The universal high-density 16S microarray (PhyloChip) contains about 30,000 probes of 16SrRNA gene targeted to several cultured microbial species and "candidate divisions". These probes target all 121 demarcated prokaryotic orders and allow simultaneous detection of 8,741 bacterial and archaeal taxa. Another microarray in use for profiling microbial communities is the Functional Gene Array (FGA). Unlike PhyloChips, FGAs are designed primarily to detect specific metabolic groups of bacteria. Thus, FGA not only reveal the community structure, but they also shed light on the in situ community metabolic potential. FGA contain probes from genes with known biological functions, so they are useful in linking microbial community composition to ecosystem functions. An FGA termed GeoChip contains >24,000 probes from all known metabolic genes involved in various biogeochemical, ecological, and environmental processes such as ammonia oxidation, methane oxidation, and nitrogen fixation.

A protein expression assay, in one embodiment, is used with the methods described herein for determining the level of expression of one or more second markers (FIG. 1, 1004; FIG. 2, 2004). For example, in one embodiment, mass spectrometry or an immunoassay such as an enzyme-linked immunosorbant assay (ELISA) is utilized to quantify the level of expression of one or more unique second markers, wherein the one or more unique second markers is a protein.

In one embodiment, the sample, or a portion thereof is subjected to Bromodeoxyuridine (BrdU) incorporation to determine the level of a second unique marker (FIG. 1, 1004; FIG. 2, 2004). BrdU, a synthetic nucleoside analog of thymidine, can be incorporated into newly synthesized DNA of replicating cells. Antibodies specific for BRdU can then be used for detection of the base analog. Thus BrdU incorporation identifies cells that are actively replicating their DNA, a measure of activity of a microorganism according to one embodiment of the methods described herein. BrdU incorporation can be used in combination with FISH to provide the identity and activity of targeted cells.

In one embodiment, the sample, or a portion thereof is subjected to microautoradiography (MAR) combined with FISH to determine the level of a second unique marker (FIG. 1, 1004; FIG. 2, 2004). MAR-FISH is based on the incorporation of radioactive substrate into cells, detection of the active cells using autoradiography and identification of the cells using FISH. The detection and identification of active cells at single-cell resolution is performed with a microscope. MAR-FISH provides information on total cells, probe targeted cells and the percentage of cells that incorporate a given radiolabelled substance. The method provides an assessment of the in situ function of targeted microorganisms and is an effective approach to study the in vivo physiology of microorganisms. A technique developed for quantification of cell-specific substrate uptake in combination with MAR-FISH is known as quantitative MAR (QMAR).

In one embodiment, the sample, or a portion thereof is subjected to stable isotope Raman spectroscopy combined with FISH (Raman-FISH) to determine the level of a second unique marker (FIG. 1, 1004; FIG. 2, 2004). This technique combines stable isotope probing, Raman spectroscopy and FISH to link metabolic processes with particular organisms. The proportion of stable isotope incorporation by cells affects the light scatter, resulting in measurable peak shifts for labelled cellular components, including protein and mRNA components. Raman spectroscopy can be used to identify whether a cell synthesizes compounds including, but not limited to: oil (such as alkanes), lipids (such as triacylglycerols (TAG)), specific proteins (such as heme proteins, metalloproteins), cytochrome (such as P450, cytochrome c), chlorophyll, chromophores (such as pigments for light harvesting carotenoids and rhodopsins), organic polymers (such as polyhydroxyalkanoates (PHA), polyhydroxybutyrate (PHB)), hopanoids, steroids, starch, sulfide, sulfate and secondary metabolites (such as vitamin B12).

In one embodiment, the sample, or a portion thereof is subjected to DNA/RNA stable isotope probing (SIP) to determine the level of a second unique marker (FIG. 1, 1004; FIG. 2, 2004). SIP enables determination of the microbial diversity associated with specific metabolic pathways and has been generally applied to study microorganisms involved in the utilization of carbon and nitrogen compounds. The substrate of interest is labelled with stable isotopes (such as $^{13}C$ or $^{15}N$) and added to the sample. Only microorganisms able to metabolize the substrate will incorporate it into their cells. Subsequently, $^{13}C$-DNA and $^{15}N$-DNA can be isolated by density gradient centrifugation and used for metagenomic analysis. RNA-based SIP can be a responsive biomarker for use in SIP studies, since RNA itself is a reflection of cellular activity.

In one embodiment, the sample, or a portion thereof is subjected to isotope array to determine the level of a second unique marker (FIG. 1, 1004; FIG. 2, 2004). Isotope arrays allow for functional and phylogenetic screening of active microbial communities in a high-throughput fashion. The technique uses a combination of SIP for monitoring the substrate uptake profiles and microarray technology for determining the taxonomic identities of active microbial communities. Samples are incubated with a $^{14}C$-labeled substrate, which during the course of growth becomes incorporated into microbial biomass. The $^{14}C$-labeled rRNA is separated from unlabeled rRNA and then labeled with fluorochromes. Fluorescent labeled rRNA is hybridized to a phylogenetic microarray followed by scanning for radioactive and fluorescent signals. The technique thus allows simultaneous study of microbial community composition and specific substrate consumption by metabolically active microorganisms of complex microbial communities.

In one embodiment, the sample, or a portion thereof is subjected to a metabolomics assay to determine the level of a second unique marker (FIG. 1, 1004; FIG. 2, 2004). Metabolomics studies the metabolome which represents the collection of all metabolites, the end products of cellular processes, in a biological cell, tissue, organ or organism. This methodology can be used to monitor the presence of microorganisms and/or microbial mediated processes since it allows associating specific metabolite profiles with different microorganisms. Profiles of intracellular and extracellular metabolites associated with microbial activity can be obtained using techniques such as gas chromatography-mass spectrometry (GC-MS). The complex mixture of a metabolomic sample can be separated by such techniques as gas chromatography, high performance liquid chromatography and capillary electrophoresis. Detection of metabolites can be by mass spectrometry, nuclear magnetic resonance (NMR) spectroscopy, ion-mobility spectrometry, electrochemical detection (coupled to HPLC) and radiolabel (when combined with thin-layer chromatography).

According to the embodiments described herein, the presence and respective number of one or more active microorganism strains in a sample are determined (FIG. 1, 1006; FIG. 2, 2006). For example, strain identity information obtained from assaying the number and presence of first markers is analyzed to determine how many occurrences of a unique first marker are present, thereby representing a unique microorganism strain (e.g., by counting the number of sequence reads in a sequencing assay). This value can be represented in one embodiment as a percentage of total sequence reads of the first maker to give a percentage of unique microorganism strains of a particular microorganism type. In a further embodiment, this percentage is multiplied by the number of microorganism types (obtained at step 1002 or 2002, see FIG. 1 and FIG. 2) to give the absolute abundance of the one or more microorganism strains in a sample and a given volume.

The one or more microorganism strains are considered active, as described above, if the level of second unique marker expression at a threshold level, higher than a threshold value, e.g., higher than at least about 5%, at least about 10%, at least about 20% or at least about 30% over a control level.

In another aspect of the invention, a method for determining the absolute abundance of one or more microorganism strains is determined in a plurality of samples (FIG. 2, see in particular, 2007). For a microorganism strain to be classified as active, it need only be active in one of the samples. The samples can be taken over multiple time points from the same source, or can be from different environmental sources (e.g., different animals).

The absolute abundance values over samples are used in one embodiment to relate the one or more active microorganism strains, with an environmental parameter (FIG. 2, 2008). In one embodiment, the environmental parameter is the presence of a second active microorganism strain. Relating the one or more active microorganism strains to the environmental parameter, in one embodiment, is carried out by determining the co-occurrence of the strain and parameter by correlation or by network analysis.

In one embodiment, determining the co-occurrence of one or more active microorganism strains with an environmental parameter comprises a network and/or cluster analysis method to measure connectivity of strains or a strain with an environmental parameter within a network, wherein the network is a collection of two or more samples that share a common or similar environmental parameter. In another embodiment, the network and/or cluster analysis method may be applied to determining the co-occurrence of two or more active microorganism strains in a sample (FIG. 2, 2008). In another embodiment, the network analysis comprises nonparametric approaches including mutual information to establish connectivity between variables. In another embodiment, the network analysis comprises linkage analysis, modularity analysis, robustness measures, betweenness measures, connectivity measures, transitivity measures, centrality measures or a combination thereof (FIG. 2, 2009). In another embodiment, the cluster analysis method comprises building a connectivity model, subspace model, distribution model, density model, or a centroid model and/or using community detection algorithms such as the Louvain, Bron-Kerbosch, Girvan-Newman, Clauset-Newman-Moore, Pons-Latapy, and Wakita-Tsurumi algorithms (FIG. 2, 2010).

In one embodiment, the cluster analysis method is a heuristic method based on modularity optimization. In a further embodiment, the cluster analysis method is the Louvain method. See, e.g., the method described by Blondel et al. (2008). Fast unfolding of communities in large networks. Journal of Statistical Mechanics: Theory and Experiment, Volume 2008, October 2008, incorporated by reference herein in its entirety for all purposes.

In another embodiment, the network analysis comprises predictive modeling of network through link mining and prediction, collective classification, link-based clustering, relational similarity, or a combination thereof. In another embodiment, the network analysis comprises differential equation based modeling of populations. In another embodiment, the network analysis comprises Lotka-Volterra modeling.

In one embodiment, relating the one or more active microorganism strains to an environmental parameter (e.g., determining the co-occurrence) in the sample comprises creating matrices populated with linkages denoting environmental parameter and microorganism strain associations.

In one embodiment, the multiple sample data obtained at step 2007 (e.g., over two or more samples which can be collected at two or more time points where each time point corresponds to an individual sample), is compiled. In a further embodiment, the number of cells of each of the one or more microorganism strains in each sample is stored in an association matrix (which can be in some embodiments, an abundance matrix). In one embodiment, the association matrix is used to identify associations between active microorganism strains in a specific time point sample using rule mining approaches weighted with association (e.g., abundance) data. Filters are applied in one embodiment to remove insignificant rules.

In one embodiment, the absolute abundance of one or more, or two or more active microorganism strains is related to one or more environmental parameters (FIG. 2, 2008), e.g., via co-occurrence determination. Environmental parameters are chosen by the user depending on the sample (s) to be analyzed and are not restricted by the methods described herein. The environmental parameter can be a parameter of the sample itself, e.g., pH, temperature, amount of protein in the sample. Alternatively, the environmental parameter is a parameter that affects a change in the identity of a microbial community (i.e., where the "identity" of a microbial community is characterized by the type of microorganism strains and/or number of particular microorganism strains in a community), or is affected by a change in the identity of a microbial community. For example, an environmental parameter in one embodiment, is the food intake of an animal or the amount of milk (or the protein or fat content of the milk) produced by a lactating ruminant In one embodiment, the environmental parameter is the presence, activity and/or abundance of a second microorganism strain in the microbial community, present in the same sample.

In some embodiments described herein, an environmental parameter is referred to as a metadata parameter.

Other examples of metadata parameters include but are not limited to genetic information from the host from which the sample was obtained (e.g., DNA mutation information), sample pH, sample temperature, expression of a particular protein or mRNA, nutrient conditions (e.g., level and/or identity of one or more nutrients) of the surrounding environment/ecosystem), susceptibility or resistance to disease, onset or progression of disease, susceptibility or resistance of the sample to toxins, efficacy of xenobiotic compounds (pharmaceutical drugs), biosynthesis of natural products, or a combination thereof.

For example, according to one embodiment, microorganism strain number changes are calculated over multiple samples according to the method of FIG. 2 (i.e., at 2001-2007). Strain number changes of one or more active strains over time is compiled (e.g., one or more strains that have initially been identified as active according to step 2006), and the directionality of change is noted (i.e., negative values denoting decreases, positive values denoting increases). The number of cells over time is represented as a network, with microorganism strains representing nodes and the abundance weighted rules representing edges. Markov chains and random walks are leveraged to determine connectivity between nodes and to define clusters. Clusters in one embodiment are filtered using metadata in order to identify clusters associated with desirable metadata (FIG. 2, 2008).

In a further embodiment, microorganism strains are ranked according to importance by integrating cell number changes over time and strains present in target clusters, with the highest changes in cell number ranking the highest.

Network and/or cluster analysis method in one embodiment, is used to measure connectivity of the one or more strains within a network, wherein the network is a collection of two or more samples that share a common or similar environmental parameter. In one embodiment, network analysis comprises linkage analysis, modularity analysis, robustness measures, betweenness measures, connectivity measures, transitivity measures, centrality measures or a combination thereof. In another embodiment, network analysis comprises predictive modeling of network through link mining and prediction, social network theory, collective classification, link-based clustering, relational similarity, or a combination thereof. In another embodiment, network analysis comprises differential equation based modeling of populations. In yet another embodiment, network analysis comprises Lotka-Volterra modeling.

Cluster analysis method comprises building a connectivity model, subspace model, distribution model, density model, or a centroid model.

Network and cluster based analysis, for example, to carry out method step 2008 of FIG. 2, can be carried out via a module. As used herein, a module can be, for example, any assembly, instructions and/or set of operatively-coupled electrical components, and can include, for example, a memory, a processor, electrical traces, optical connectors, software (executing in hardware) and/or the like.

Bovine Pathogen Resistance and Clearance

In some aspects, the present disclosure is drawn to administering one or more microbial compositions described herein to cows to clear the gastrointestinal tract of pathogenic microbes. In some embodiments, the present disclosure is further drawn to administering microbial compositions described herein to prevent colonization of pathogenic microbes in the gastrointestinal tract. In some embodiments, the administration of microbial compositions described herein further clears pathogens from the integument and the respiratory tract of cows, and/or prevent colonization of pathogens on the integument and in the respiratory tract. In some embodiments, the administration of microbial compositions described herein reduce leaky gut/intestinal permeability, inflammation, and/or incidence of liver disease.

In some embodiments, the microbial compositions of the present disclosure comprise one or more microbes that are present in the gastrointestinal tract of cows at a relative abundance of less than 15%, 14%, 13%, 12%, 11%, 10%, 9%, 8%, 7%, 6%, 5%, 4%, 3%, 2%, 1%, 0.5%, 0.1%, or 0.01%.

In some embodiments, after administration of microbial compositions of the present disclosure the one or more microbes are present in the gastrointestinal tract of the cow at a relative abundance of at least 0.5%, 1%, 5%, 10%, 15%, 20%, 25%, 30%, 35%, 40%, 45%, 50%, 55%, 60%, 65%, 70%, 75%, 80%, 85%, 90%, or 95%.

Pathogenic microbes of cows may include the following: *Clostridium perfringens*, *Clostridium botulinum*, *Salmonella typi*, *Salmonella typhimurium*, *Salmonella enterica*, *Salmonella pullorum*, *Erysipelothrix insidiosa*, *Campylobacter jejuni*, *Campylobacter coli*, *Campylobacter lari*, *Listeria monocytogenes*, *Streptococcus agalactiae*, *Streptococcus dysgalactiae*, *Corynebacterium bovis*, *Mycoplasma* sp., *Citrobacter* sp., *Enterobacter* sp., *Pseudomonas aeruginosa*, *Pasteurella* sp., *Bacillus cereus*, *Bacillus licheniformis*, *Streptococcus uberis*, *Staphylococcus aureus*, and pathogenic strains of *Escherichia coli* and *Staphylococcus aureus*. In some embodiments, the pathogenic microbes include viral pathogens. In some embodiments, the pathogenic microbes are pathogenic to both cows and humans. In some embodiments, the pathogenic microbes are pathogenic to either cows or humans.

In some embodiments, the administration of compositions of the present disclosure to cows modulate the makeup of the gastrointestinal microbiome such that the administered microbes outcompete microbial pathogens present in the gastrointestinal tract. In some embodiments, the administration of compositions of the present disclosure to cows harboring microbial pathogens outcompetes the pathogens and clears cows of the pathogens. In some embodiments, the administration of compositions of the present disclosure results in the stimulation of host immunity, and aid in clearance of the microbial pathogens. In some embodiments, the administration of compositions of the present disclosure introduce microbes that produce bacteriostatic and/or bactericidal components that decrease or clear the cows of the microbial pathogens. (U.S. Pat. No. 8,345,010).

In some embodiments, challenging cows with a microbial colonizer or microbial pathogen after administering one or more compositions of the present disclosure prevents the microbial colonizer or microbial pathogen from growing to a relative abundance of greater than 15%, 14%, 13%, 12%, 11%, 10%, 9%, 8%, 7%, 6%, 5%, 4%, 3%, 2%, 1%, 0.5%, 0.1%, or 0.01%. In further embodiments, challenging cows with a microbial colonizer or microbial pathogen after administering one or more compositions of the present disclosure prevents the microbial colonizer or microbial pathogen from colonizing cows.

In some embodiments, clearance of the microbial colonizer or microbial pathogen occurs in less than 25 days, less than 24 days, less than 23 days, less than 22 days, less than 21 days, less than 20 days, less than 19 days, less than 18 days, less than 17 days, less than 16 days, less than 15 days, less than 14 days, less than 13 days, less than 12 days, less than 11 days, less than 10 days, less than 9 days, less than 8 days, less than 7 days, less than 6 days, less than 5 days, less than 4 days, less than 3 days, or less than 2 days post administration of the one or more compositions of the present disclosure.

In some embodiments, clearance of the microbial colonizer or microbial pathogen occurs within 1-30 days, 1-25 days, 1-20 day, 1-15 days, 1-10 days, 1-5 days, 5-30 days, 5-25 days, 5-20 days, 5-15 days, 5-10 days, 10-30 days, 10-25 days, 10-20 days, 10-15 days, 15-30 days, 15-25 days, 15-20 days, 20-30 days, 20-25 days, or 25-30 days post administration of the one or more compositions of the present disclosure.

Improved Traits

In some aspects, the present disclosure is drawn to administering microbial compositions described herein to ruminants to improve one or more traits through the modulation of aspects of milk production, milk quantity, milk quality, ruminant digestive chemistry, and efficiency of feed utilization and digestibility.

In some embodiments, improving the quantity of milk fat produced by a ruminant is desirable, wherein milk fat includes triglycerides, triacylglycerides, diacylglycerides, monoacylglycerides, phospholipids, cholesterol, glycolipids, and free fatty acids. In further embodiments, free fatty acids include short chain fatty acids (i.e., C4:0, C6:0, and C8:0), medium chain fatty acids (i.e., C10:0, C10:1, C12:0, C14:0, C14:1, and C15:0), and long chain fatty acids (i.e., C16:0, C16:1, C17:0, C17:1, C18:0, C18:1, C18:2, C18:3, and C20:0). In further embodiments, it is desirable to achieve an increase in milk fat efficiency, which is measured by the total weight of milk fat produced, divided by the weight of feed ingested. The weight of milk fat produced is calculated from the measured fat percentage multiplied by the weight of milk produced.

In some embodiments, improving the quantity of carbohydrates in milk produced by a ruminant is desirable, wherein carbohydrates include lactose, glucose, galactose, and oligosaccharides. Tao et al. (2009. *J. Dairy Sci.* 92:2991-3001) disclose numerous oligosaccharides that may be found in bovine milk.

In some embodiments, improving the quantity of proteins in milk produced by a ruminant, wherein proteins include caseins and whey. In some embodiments, proteins of interest are only those proteins produced in milk. In other embodiments, proteins of interest are not required to be produced only in milk. Whey proteins include immunoglobulins, serum albumin, beta-lactoglobulin, and alpha-lactoglobulin.

In some embodiments, improving the quantity of vitamins in milk produced by a ruminant is desirable. Vitamins found in milk include the fat-soluble vitamins of A, D, E, and K; as well as the B vitamins found in the aqueous phase of the milk.

In some embodiments, improving the quantity of minerals in milk produced by a ruminant is desirable. Minerals found in milk include iron, zinc, copper, cobalt, magnesium, manganese, molybdenum, calcium, phosphorous, potassium, sodium, chlorine, and citric acid. Trace amounts of the following may be found in milk: aluminum, arsenic, boron, bromine, cadmium, chromium, fluorine, iodine, lead, nickel, selenium, silicon, silver, strontium, and vanadium.

In some embodiments, improving the milk yield and milk volume produced by a ruminant is desirable. In some embodiments, it is further desirable if the increase in milk yield and volume is not accompanied by simply an increase in solute volume.

In some embodiments improving energy-corrected milk (ECM) is desirable. In further embodiments, improving ECM amounts to increasing the calculated ECM output. In some embodiments, the ECM is calculated as follows: ECM=(0.327×milk pounds)+(12.95×fat pounds)+(7.2×protein pounds).

In some embodiments, improving the efficiency and digestibility of animal feed is desirable. In some embodiments, increasing the degradation of lignocellulosic components from animal feed is desirable. Lignocellulosic components include lignin, cellulose, and hemicellulose.

In some embodiments, increasing the concentration of fatty acids in the rumen of ruminants is desirable. Fatty acids include acetic acid, propionic acid, and butyric acid. In some embodiments, maintaining the pH balance in the rumen to prevent lysis of beneficial microbial consortia is desirable. In some embodiments, maintaining the pH balance in the rumen to prevent a reduction of beneficial microbial consortia is desirable.

In some embodiments, decreasing the amount of methane and manure produced by ruminants is desirable.

In some embodiments, improving the dry matter intake is desirable. In some embodiments, improving the efficiency of nitrogen utilization of the feed and dry matter ingested by ruminants is desirable.

In some embodiments, the improved traits of the present disclosure are the result of the administration of the presently described microbial compositions. It is thought that the microbial compositions modulate the microbiome of the ruminants such that the biochemistry of the rumen is changed in such a way that the ruminal liquid and solid substratum are more efficiently and more completely degraded into subcomponents and metabolites than the rumens of ruminants not having been administered microbial compositions of the present disclosure.

In some embodiments, the increase in efficiency and the increase of degradation of the ruminal substratum result in an increase in improved traits of the present disclosure.

Mode of Action: Digestibility Improvement in Ruminants

Figure 16:
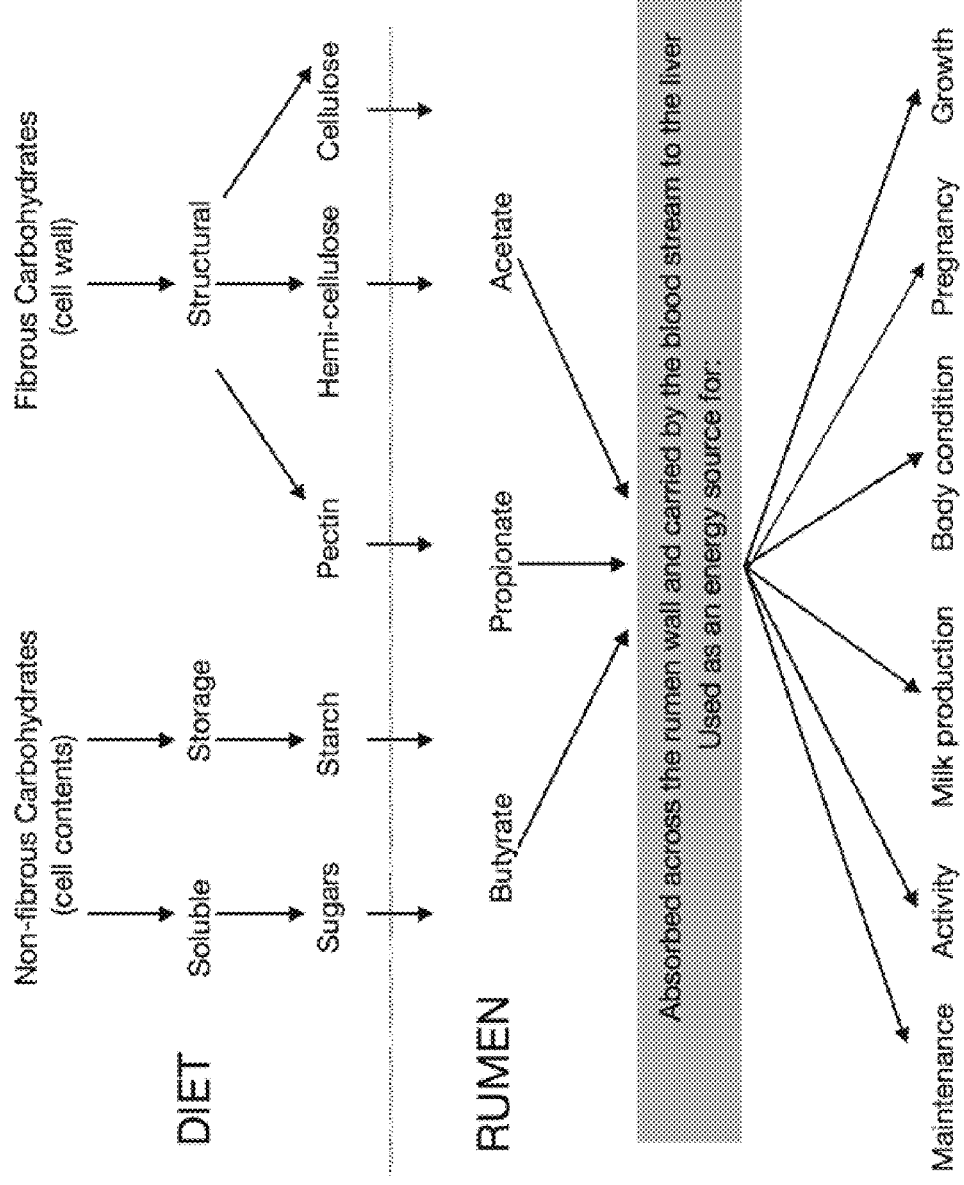
FIG. 16 depicts a diagram that exemplifies how the diet influences the production of volatile fatty acids which in turn modulate milk production, body condition, growth, etc. Reproduced from Moran, 2005. Tropical dairy farming: feeding management for small holder dairy farmers in the humic tropics (Chapter 5), Landlinks Press, 312 pp.

The rumen is a specialized stomach dedicated to the digestion of feed components in ruminants. A diverse microbial population inhabits the rumen, where their primary function revolves around converting the fibrous and non-fibrous carbohydrate components into useable sources of energy and protein (FIG. 16). Cellulose, in particular, forms up to 40% of plant biomass and is considered indigestible by mammals. It also is tightly associated with other structural carbohydrates, including hemicellulose, pectin, and lignin. The cellulolytic microbes in the rumen leverage extensive enzymatic activity in order break these molecules down into simple sugars and volatile fatty acids. This enzymatic activity is critical to the extraction of energy from feed, and more efficient degradation ultimately provides more energy to the animal. The soluble sugars found in the non-fibrous portion of the feed are also fermented into gases and volatile fatty acids such as butyrate, propionate, and acetate. Volatile fatty acids arising from the digestion of both the fibrous and non-fibrous components of feed are ultimately the main source of energy of the ruminant.

Individual fatty acids have been tested in ruminants in order to identify their impacts on varying aspects of production.

Acetate:

Structural carbohydrates produce large amounts of acetate when degraded. An infusion of acetate directly into the rumen was shown to improve the yield of milk, as well as the amount of milk fat produced. Acetate represents at least 90% of acids in the peripheral blood—it is possible that acetate can be directly utilized by mammary tissue as a source of energy. See Rook and Balch. 1961. Brit. J. Nutr. 15:361-369.

Propionate:

Propionate has been shown to increase milk protein production, but decrease milk yield. See Rook and Balch. 1961. Brit. J. Nutr. 15:361-369.

Butyrate:

An infusion of butyrate directly into the rumen of dairy cows increases milk fat production without changing milk yield. See Huhtanen et al. 1993. J. Dairy Sci. 76:1114-1124.

Network Analysis

A network and/or cluster analysis method, in one embodiment, is used to measure connectivity of the one or more strains within a network, wherein the network is a collection of two or more samples that share a common or similar environmental parameter. In one embodiment, network analysis comprises linkage analysis, modularity analysis, robustness measures, betweenness measures, connectivity measures, transitivity measures, centrality measures or a combination thereof. In another embodiment, network analysis comprises predictive modeling of network through link mining and prediction, social network theory, collective classification, link-based clustering, relational similarity, or a combination thereof. In another embodiment, network analysis comprises mutual information, maximal information coefficient (MIC) calculations, or other nonparametric methods between variables to establish connectivity. In another embodiment, network analysis comprises differential equation based modeling of populations. In yet another embodiment, network analysis comprises Lotka-Volterra modeling.

The environmental parameter can be a parameter of the sample itself, e.g., pH, temperature, amount of protein in the sample. Alternatively, the environmental parameter is a parameter that affects a change in the identity of a microbial community (i.e., where the "identity" of a microbial community is characterized by the type of microorganism strains and/or number of particular microorganism strains in a community), or is affected by a change in the identity of a microbial community. For example, an environmental parameter in one embodiment, is the food intake of an animal or the amount of milk (or the protein or fat content of the milk) produced by a lactating ruminant In one embodiment, the environmental parameter is the presence, activity and/or abundance of a second microorganism strain in the microbial community, present in the same sample. In some embodiments, an environmental parameter is referred to as a metadata parameter.

Other examples of metadata parameters include but are not limited to genetic information from the host from which the sample was obtained (e.g., DNA mutation information), sample pH, sample temperature, expression of a particular protein or mRNA, nutrient conditions (e.g., level and/or identity of one or more nutrients) of the surrounding environment/ecosystem), susceptibility or resistance to disease, onset or progression of disease, susceptibility or resistance of the sample to toxins, efficacy of xenobiotic compounds (pharmaceutical drugs), biosynthesis of natural products, or a combination thereof.

EXAMPLES

Example I. Increase Total Milk Fat, Milk Protein, and Energy-Corrected Milk (ECM) in Cows The methods of Example I aim to increase the total amount of milk fat and milk protein produced by a lactating ruminant, and the calculated ECM.

The methodologies presented herein—based upon utilizing the disclosed isolated microbes, consortia, and compositions comprising the same—demonstrate an increase in the total amount of milk fat and milk protein produced by a lactating ruminant. These increases were realized without the need for further addition of hormones.

In this example, a microbial consortium comprising two isolated microbes, Ascusb_3138 (SEQ ID NO:28; deposited as NRRL Y-67248) and Ascusf_15 (SEQ ID NO:32; deposited as NRRL Y67249), was administered to Holstein cows in mid-stage lactation over a period of five weeks.

The cows were randomly assigned into 2 groups of 8, wherein one of the groups was a control group that received a buffer lacking a microbial consortium. The second group, the experimental group, was administered a microbial consortium comprising Ascusb_3138 (SEQ ID NO:28) and Ascusf_15 (SEQ ID NO:32) once per day for five weeks.

Each of the cows were housed in individual pens and were given free access to feed and water. The diet was a high milk yield diet. Cows were fed ad libitum and the feed was weighed at the end of the day, and prior day refusals were weighed and discarded. Weighing was performed with a PS-2000 scale from Salter Brecknell (Fairmont, Minn.).

Cows were cannulated such that a cannula extended into the rumen of the cows. Cows were further provided at least 10 days of recovery post cannulation prior to administering control dosages or experimental dosages.

Each administration consisted of 20 ml of a neutral buffered saline, and each administration consisted of approximately $10^9$ cells suspended in the saline. The control group received 20 ml of the saline once per day, while the experimental group received 20 ml of the saline further comprising $10^9$ microbial cells of the described microbial consortium.

The rumen of every cow was sampled on days 0, 7, 14, 21, and 35, wherein day 0 was the day prior to microbial administration. Note that the experimental and control administrations were performed after the rumen was sampled on that day. Daily sampling of the rumen, beginning on day 0, with a pH meter from Hanna Instruments (Woonsocket, R.I.) was inserted into the collected rumen fluid for recordings. Rumen sampling included both particulate and fluid sampling from the center, dorsal, ventral, anterior, and posterior regions of the rumen through the cannula, and all five samples were pooled into 15 ml conical vials containing 1.5 ml of stop solution (95% ethanol, 5% phenol). A fecal sample was also collected on each sampling day, wherein feces were collected from the rectum with the use of a palpation sleeve. Cows were weighed at the time of each sampling.

Fecal samples were placed in a 2 ounce vial, stored frozen, and analyzed to determine values for apparent neutral detergent fibers (NDF) digestibility, apparent starch digestibility, and apparent protein digestibility. Rumen sampling consisted of sampling both fluid and particulate portions of the rumen, each of which was stored in a 15 ml conical tube. Cells were fixed with a 10% stop solution (5% phenol/95% ethanol mixture) and kept at 4° C. and shipped to Ascus Biosciences (Vista, Calif.) on ice.

The milk yield was measured twice per day, once in the morning and once at night. Milk composition (% fats and % proteins, etc.) was measured twice per day, once in the morning and once at night. Milk samples were further analyzed with near-infrared spectroscopy for protein fats, solids, analysis for milk urea nitrogen (MUN), and somatic cell counts (SCC) at the Tulare Dairy Herd Improvement Association (DHIA) (Tulare, Calif.). Feed intake of individual cows and rumen pH were determined once per day.

A sample of the total mixed ration (TMR) was collected the final day of the adaptation period, and then successively collected once per week. Sampling was performed with the quartering method, wherein the samples were stored in vacuum sealed bags which were shipped to Cumberland Valley Analytical Services (Hagerstown, Md.) and analyzed with the NIR1 package.

The final day of administration of buffer and/or microbial bioconsortia was on day 35, however all other measurements and samplings continued as described until day 46.

TABLE 12

Dry matter intake, milk production and composition, body weight (BW) gain, and rumen pH least square means (±SEM) of cows assigned to Control and Inoculated groups.

| | Treatment | |
|---|---|---|
| Outcome | Control | Inoculated |
| Dry matter intake, kg | 26.2 ± 2.8 | 30.2 ± 1.2 |
| Milk yield, kg | 25.7 ± 1.9 | 30.6 ± 1.9 |
| FCM, kg | 27.7 ± 2.5 | 32.5 ± 2.5 |
| ECM, kg | 27.2 ± 2.4 | 32.1 ± 2.4 |
| Milk components, % | | |
| Crude Protein | 3.08 ± 0.06 | 3.27 ± 0.11 |
| Fat | 3.87 ± 0.08 | 4.06 ± 0.08 |
| Lactose | 4.64 ± 0.10 | 4.73 ± 0.03 |
| Milk components yield, kg | | |
| Crude Protein | 0.80 ± 0.07 | 0.97 ± 0.07 |
| Fat | 1.01 ± 0.10 | 1.20 ± 0.10 |
| MUN, mg/dL | 6.17 ± 0.60 | 7.41 ± 0.45 |
| FCM/DMI | 1.22 ± 0.07 | 1.10 ± 0.07 |
| Body weight gain, kg/day | 0.78 ± 0.44 | 1.46 ± 0.43 |
| Rumen pH | 6.24 ± 0.09 | 6.05 ± 0.09 |

Table 12 reveals the effects of daily administration of an Ascus microbial consortium on the performance of multiparous Holstein cows (between 60 and 120 days in milk). Marked differences between the control and inoculated treatments were observed. The inoculated group experienced increases in all parameters except FCM/DMI and rumen pH. The weekly values at the beginning of the intervention period when cows were still adapting to the treatment are included in the calculations.

FIGS. 4-7 demonstrate the significant effects of the microbial consortia on dairy cows for daily milk yield, daily milk crude protein yield, daily milk fat yield, and daily energy corrected milk yield over time. After an initial adaptation period, during which the microbes were observed to colonize the rumen, the production characteristics of the inoculated treatment group increased and diverged from the control group.

Figure 3:
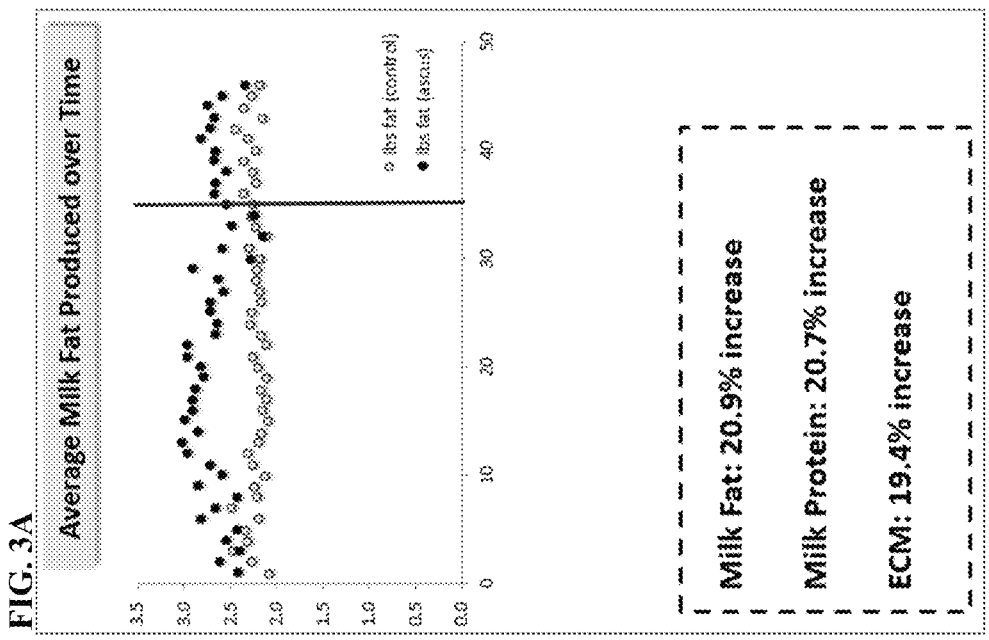
FIG. 3A, FIG. 3B, and FIG. 3C depict the results of a field trial in which dairy cows were administered a composition comprising Ascusb_3138 and Ascusf_15.
Figure 4:
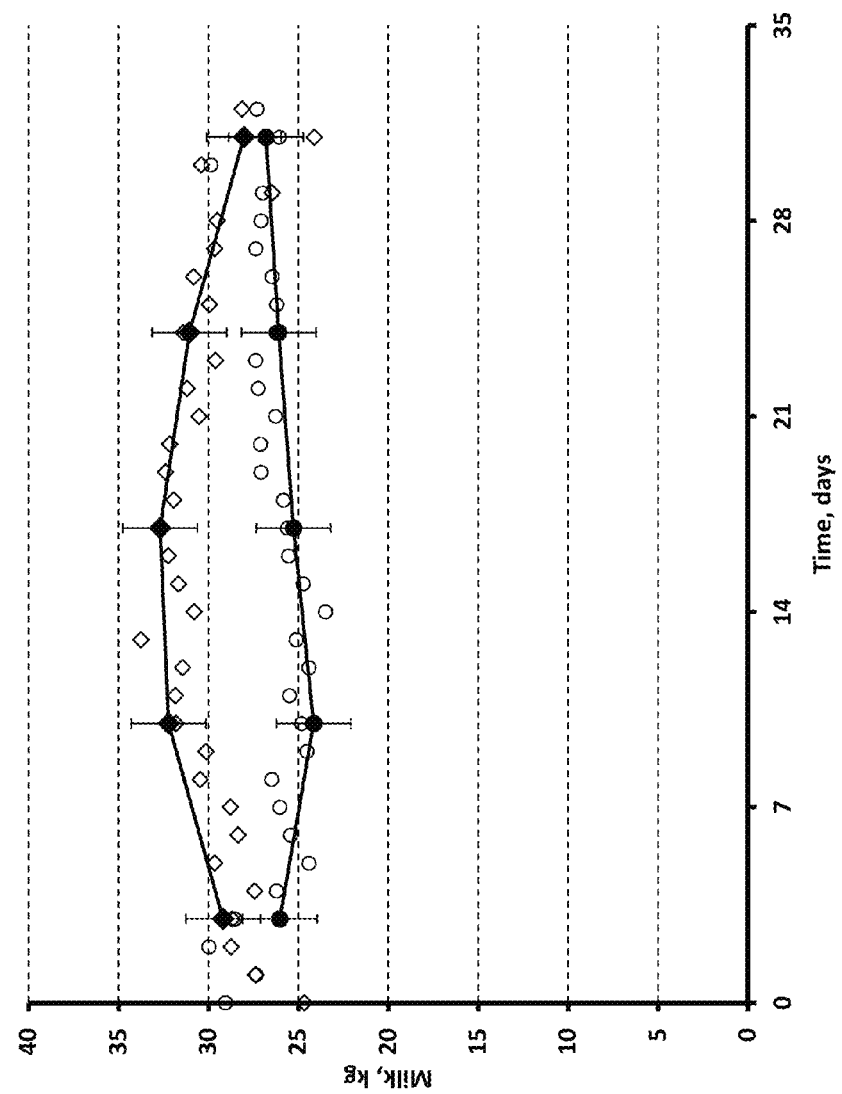
FIG. 4 depicts the milk yield (kg) daily means (no fill) and covariate adjusted weekly least square means (solid fill) ±SEM of cows assigned either to Control (circle) or Inoculated (trapezoid) by intervention period study days.
Figure 5:
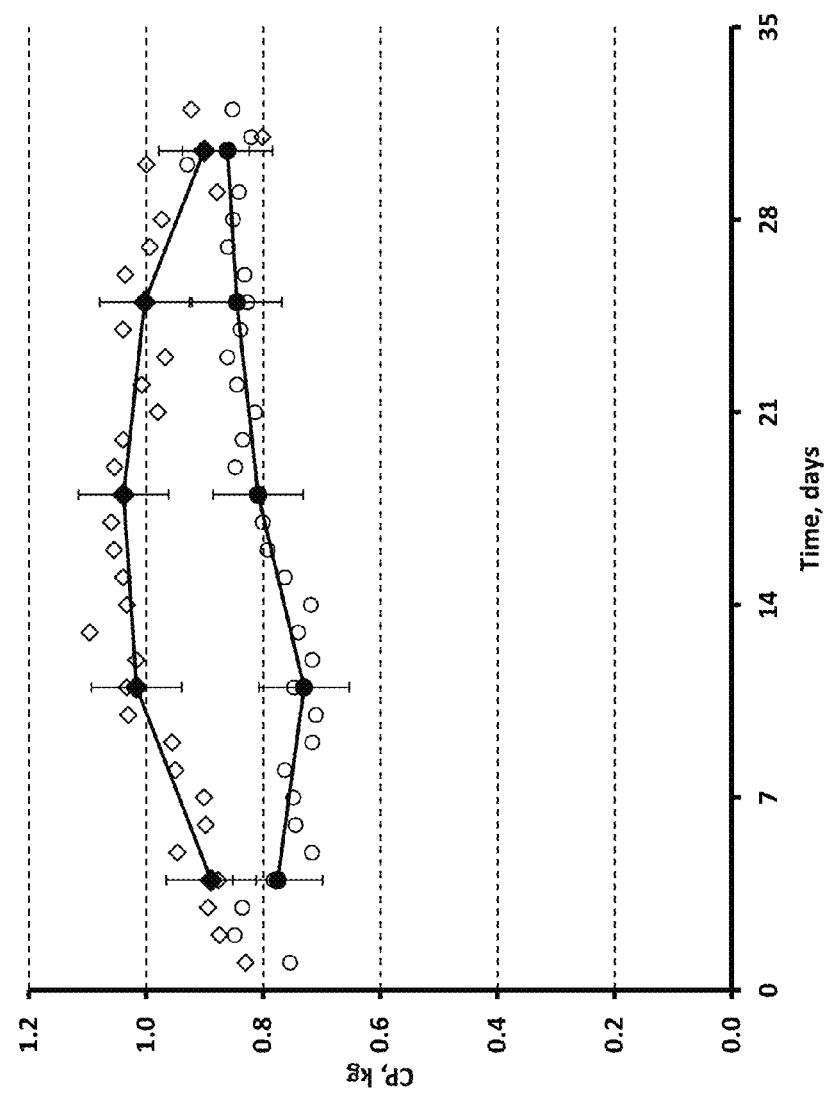
FIG. 5 depicts the milk crude protein yield (CP, kg) daily means (no fill) and weekly least square means (solid fill) ±SEM of cows assigned either to Control (circle) or Inoculated (trapezoid) by Intervention period study days.
Figure 6:
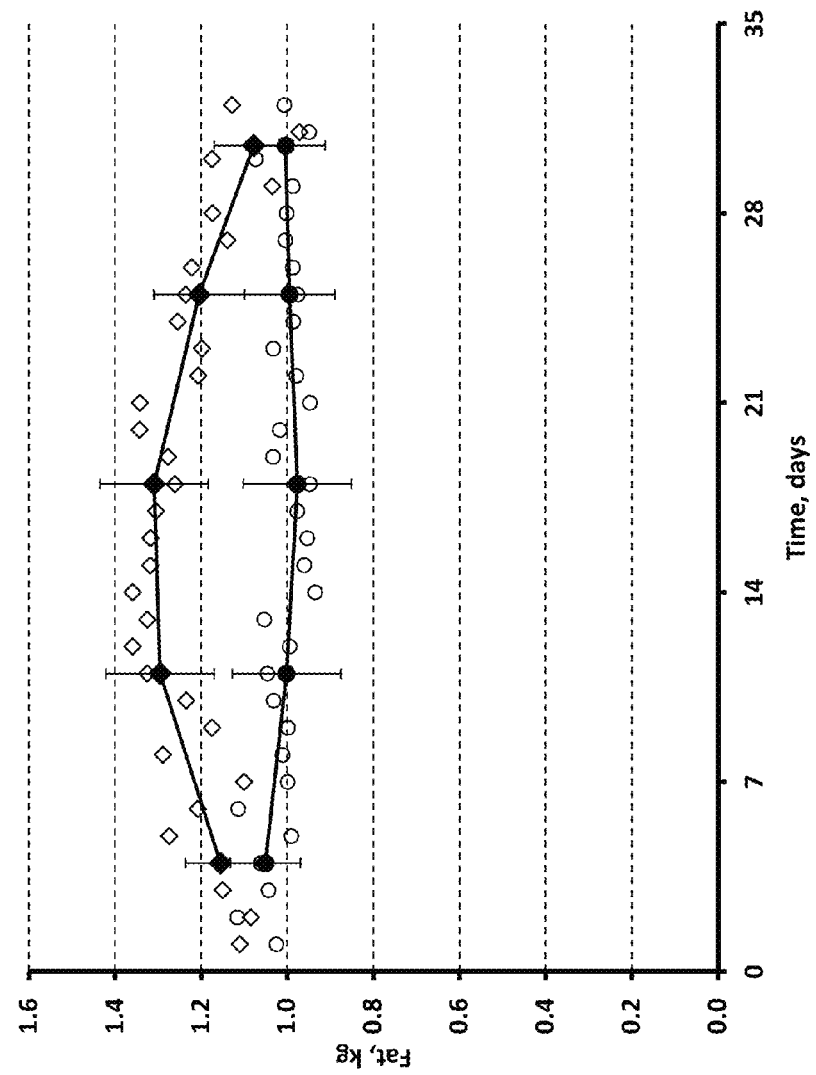
FIG. 6 depicts the milk fat yield (kg) daily means (no fill) and weekly least square means (solid fill)±SEM of cows assigned either to Control (circle) or Inoculated (trapezoid) by Intervention period study days.
Figure 7:
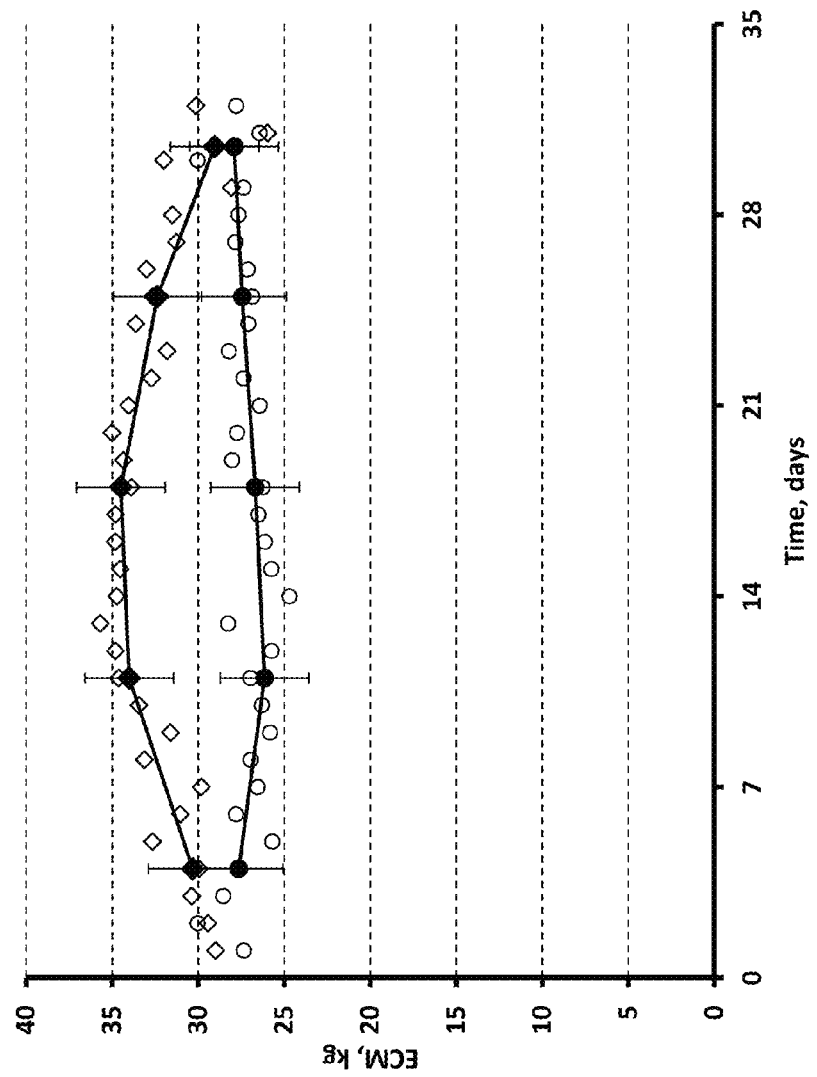
FIG. 7 depicts the energy corrected milk yield (ECM, kg) daily means (no fill) and weekly least square means (solid fill)±SEM of cows assigned either to Control (circle) or Inoculated (trapezoid) by Intervention period study days.

FIG. 3A demonstrates that cows that were administered the microbial consortia exhibited a 20.9% increase in the average production of milk fat versus cows that were administered the buffered solution alone. FIG. 3B demonstrates that cows that were administered the microbial consortia exhibited a 20.7% increase in the average production of milk protein versus cows that were administered the buffered solution alone. FIG. 3C demonstrates that cows that were administered the microbial consortia exhibited a 19.4% increase in the average production of energy corrected milk. The increases seen in FIG. 3A-C became less pronounced after the administration of the consortia ceased, as depicted by the vertical line intersecting the data points.

Figure 14:
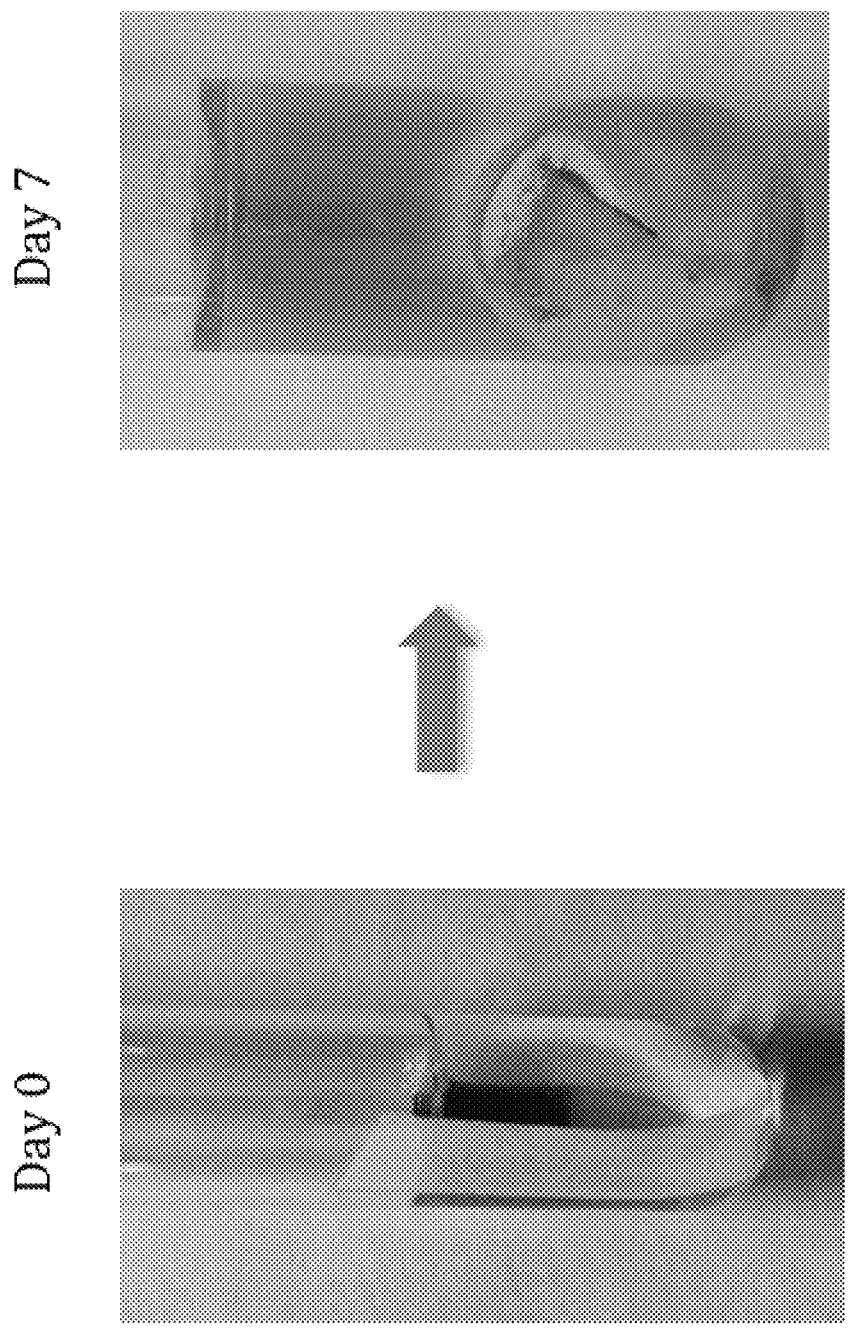
FIG. 14 depicts an undegraded carbon source (Day 0) and a degraded carbon source (Day 7), as utilized in the insoluble carbon source assays.
Figure 15:
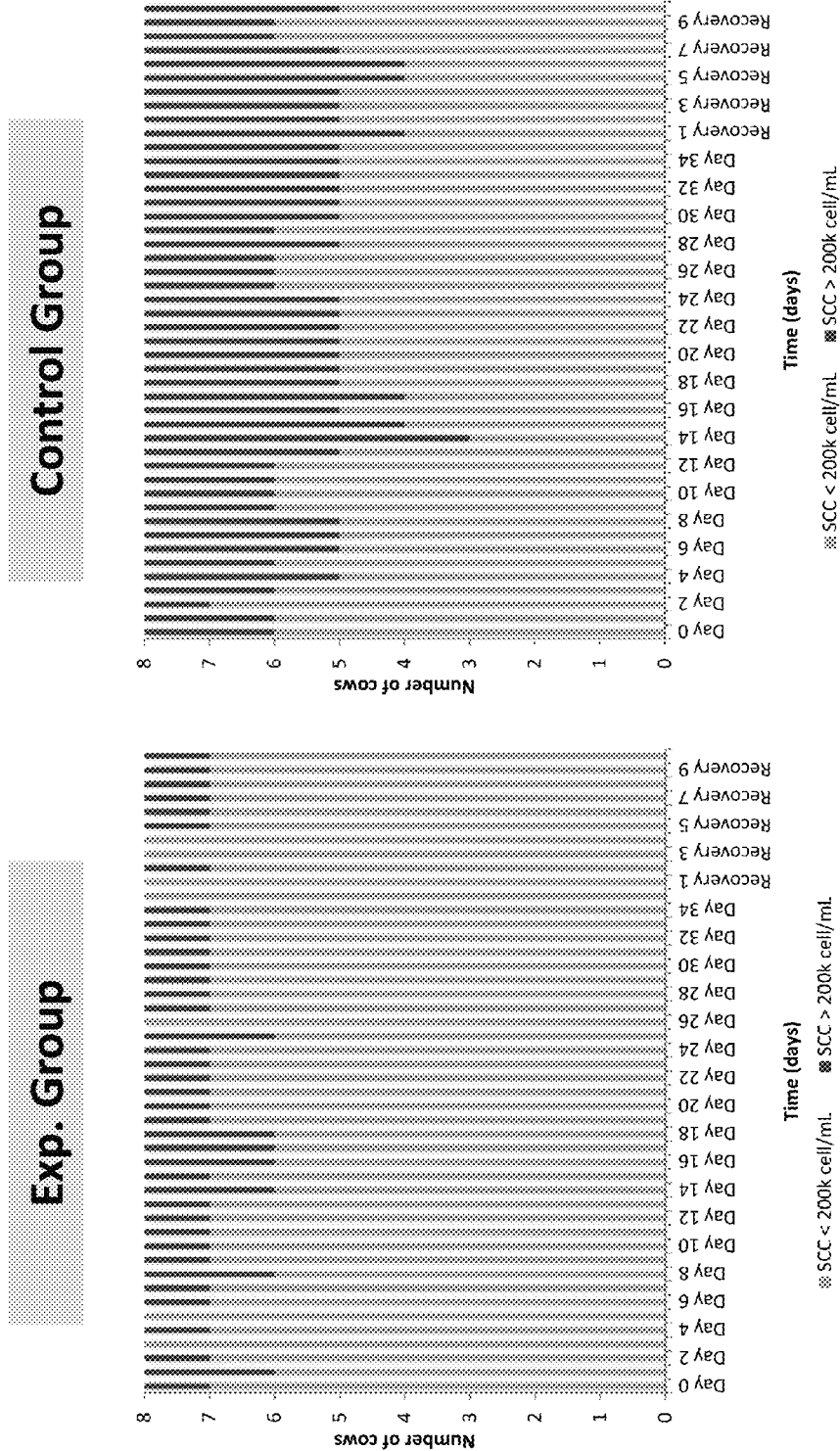
FIG. 15 depicts a decrease in the number of cows exhibiting greater than 200,000 somatic cell counts (SSC)/mL milk in dairy cows that were administered a microbial compostion of the present disclosure versus dairy cows that were not administered a microbial composition of the present disclosure.

FIG. 14 clearly identifies the effect of microbial consortia on the somatic cell count in the milk. The experimental group of cows receiving the microbial consortia exhibited a decrease in the number of cows with greater than 200,000 somatic cells/ml of milk. In the field of dairy farming, the SCC is a strong indicator of milk quality. The majority of somatic cells found in milk are leukocytes, immune cells that accumulate in a particular tissue/fluid in increasing numbers usually due to an immune response to a pathogen. Generally, the lower the SCC the higher the quality of milk. Dosogne et al. 2011. *J. Dairy Sci.* 86(3):828-834.

Example II. Increase Total Milk Fat and Milk Protein in Cows

In certain embodiments of the disclosure, the present methods aim to increase the total amount of milk fat and milk protein produced by a lactating ruminant.

The methodologies presented herein—based upon utilizing the disclosed isolated microbes, consortia, and compositions comprising the same—have the potential to increase the total amount of milk fat and milk protein produced by a lactating ruminant. These increases can be realized without the need for further addition of hormones.

In this example, seven microbial consortia comprising isolated microbes from Table 1 are administered to Holstein cows in mid-stage lactation over a period of six weeks. The consortia are as follows:

Consortium 1—Ascusb_7, Ascusb_32, Ascusf_45, and Ascusf_24;

Consortium 2—Ascusb_7, Ascusb_1801, Ascusf_45, and Ascusf_24;

Consortium 3—Ascusb_7, Ascusb_268, Ascusf_45, and Ascusf_24;

Consortium 4—Ascusb_7, Ascusb_232, Ascusf_45, and Ascusf_24;

Consortium 5—Ascusb_7, Ascusb_32, Ascusf_45, and Ascusf_249;

Consortium 6—Ascusb_7, Ascusb_32, Ascusf_45, and Ascusf_353; and

Consortium 7—Ascusb_7, Ascusb_32, Ascusf_45, and Ascusf_23.

Consortium 8—Ascusb_3138, Ascusb_1801, Ascusf_45, and Ascusf_15.

Consortium 9—Ascusb_3138, Ascusb_268, Ascusf_45, and Ascusf_15.

Consortium 10—Ascusb_3138, Ascusb_232, Ascusf_23, and Ascusf_15.

Consortium 11—Ascusb_7, Ascusb_3138, Ascusf_15, and Ascusf_249.

Consortium 12—Ascusb_7, Ascusb_3138, Ascusf_45, and Ascusf_15.

Consortium 13—Ascusb_3138, Ascusb_32, Ascusf_15, and Ascusf_23.

Consortium 14—Ascusb_3138 and Ascusf_15.

The cows are randomly assigned into 15 groups of 8, wherein one of the groups is a control group that receives a buffer lacking a microbial consortium. The remaining seven groups are experimental groups and will each be administered one of the thirteen microbial bioconsortia once per day for six weeks. Each of the cows are held in individual pens to mitigate cross-contamination and are given free access to feed and water. The diet is a high milk yield diet. Cows are fed twice per day and the feed will be weighed at each feeding, and prior day refusals will be weighed and discarded. Weighing is performed with a PS-2000 scale from Salter Brecknell (Fairmont, Minn.).

Cows are cannulated such that a cannula extends into the rumen of the cows. Cows are further provided at least 10 days of recovery post cannulation prior to administering control dosages or experimental dosages.

Each administration consists of 5 ml of a neutral buffered saline, and each administration consists of approximately $10^9$ cells suspended in the saline. The control group receives 5 ml of the saline once per day, while the experimental groups receive 5 ml of the saline further comprising $10^9$ microbial cells of the described consortia.

The rumen of every cow is sampled on days 0, 7, 14, 21, and 35, wherein day 0 is the day prior to microbial administration. Note that the experimental and control administrations are performed after the rumen has been sampled on that day. Daily sampling of the rumen, beginning on day 0, with a pH meter from Hanna Instruments (Woonsocket, R.I.) is inserted into the collected rumen fluid for recordings. Rumen sampling included both particulate and fluid sampling from the center, dorsal, ventral, anterior, and posterior regions of the rumen through the cannula, and all five samples were pooled into 15 ml conical vials containing 1.5 ml of stop solution (95% ethanol, 5% phenol). A fecal sample is also collected on each sampling day, wherein feces are collected from the rectum with the use of a palpation sleeve. Cows are weighed at the time of each sampling.

Fecal samples are placed in a 2 ounce vial, stored frozen, and analyzed to determine values for apparent NDF digestibility, apparent starch digestibility, and apparent protein digestibility. Rumen sampling consists of sampling both fluid and particulate portions of the rumen, each of which is stored in a 15 ml conical tube. Cells are fixed with a 10% stop solution (5% phenol/95% ethanol mixture) and kept at 4° C. and shipped to Ascus Biosciences (Vista, Calif.) on ice.

The milk yield is measured twice per day, once in the morning and once at night. Milk composition (% fats and % proteins, etc.) is measured twice per day, once in the morning and once at night. Milk samples are further analyzed with near-infrared spectroscopy for protein fats, solids, analysis for milk urea nitrogen (MUN), and somatic cell counts (SCC) at the Tulare Dairy Herd Improvement Association (DHIA) (Tulare, Calif.). Feed intake of individual cows and rumen pH are determined once per day.

A sample of the total mixed ration (TMR) is collected the final day of the adaptation period, and then successively collected once per week. Sampling is performed with the quartering method, wherein the samples are stored in vacuum sealed bags which are shipped to Cumberland Valley Analytical Services (Hagerstown, Md.) and analyzed with the NIR1 package.

In some embodiments, the percent fats and percent protein of milk in each of the experimental cow groups is expected to demonstrate a statistically significant increase over the percent fats and percent protein of milk in the control cow group. In other embodiments, the increase is not expected to be statistically significant, but it is expected to be still quantifiable.

Example III. Shifting the Microbiome of Ruminants

In certain embodiments of the disclosure, the present methods aim to modulate the microbiome of ruminants through the administration of one or more microbes to the gastrointestinal tract of ruminants.

The methodologies presented herein—based upon utilizing the disclosed isolated microbes, consortia, and compositions comprising the same—have the potential to modulate the microbiome of ruminants. The modulation of a ruminant's gastrointestinal microbiome may lead to an increase of desirable traits of the present disclosure.

In this example, the microbial consortia of Table 5 are administered to Holstein cows over a period of six weeks.

The cows are randomly assigned into 37 groups of 8, wherein one of the groups is a control group that receives a buffer lacking a microbial consortium. The remaining thirty-six groups are experimental groups and will each be administered one of the thirty-six microbial consortia once per day for six weeks. Each of the cows are held in individual pens to mitigate cross-contamination and are given free access to feed and water. The diet is a high milk yield diet. Cows are fed twice per day and the feed will be weighed at each feeding, and prior day refusals will be weighed and discarded. Weighing is performed with a PS-2000 scale from Salter Brecknell (Fairmont, Minn.).

Cows are cannulated such that a cannula extends into the rumen of the cows. Cows are further provided at least 10 days of recovery post cannulation prior to administering control dosages or experimental dosages.

Each administration consists of 5 ml of a neutral buffered saline, and each administration consists of approximately $10^9$ cells suspended in the saline. The control group receives 5 ml of the saline once per day, while the experimental groups receive 5 ml of the saline further comprising $10^9$ microbial cells of the described consortia.

The rumen of every cow is sampled on days 0, 7, 14, 21, and 35, wherein day 0 is the day prior to administration. Note that the experimental and control administrations are performed after the rumen has been sampled on that day. Daily sampling of the rumen, beginning on day 0, with a pH meter from Hanna Instruments (Woonsocket, R.I.) is inserted into the collected rumen fluid for recordings. Rumen sampling included both particulate and fluid sampling from the center, dorsal, ventral, anterior, and posterior regions of the rumen through the cannula, and all five samples were pooled into 15 ml conical vials containing 1.5 ml of stop solution (95% ethanol, 5% phenol). A fecal sample is also collected on each sampling day, wherein feces are collected from the rectum with the use of a palpation sleeve. Cows are weighed at the time of each sampling.

Fecal samples are placed in a 2 ounce vial, stored frozen, and analyzed to determine values for apparent NDF digestibility, apparent starch digestibility, and apparent protein digestibility. Rumen sampling consists of sampling both fluid and particulate portions of the rumen, each of which is stored in a 15 ml conical tube. Cells are fixed with a 10% stop solution (5% phenol/95% ethanol mixture) and kept at 4° C. and shipped to Ascus Biosciences (Vista, Calif.) on ice.

The samples of fluid and particulate portions of the rumen, as well as the fecal samples are each evaluated for microbiome fingerprinting utilizing the T-RFLP method combined with nMDS ordination and PERMANOVA statistics.

In some embodiments, the ruminal and fecal microbiome in each of the experimental cow groups is expected to demonstrate a statistically significant change in the microbiomes over the microbiomes in the control cow group as well as the 0 day microbiome samples, wherein the change is a significant increase in the proportion of microbes administered in the experimental administrations. In other embodiments, the increase is not expected to be statistically significant, but it is expected to be still quantifiable.

Example IV. Milk Fat Produced Versus Absolute Abundance of Microbes

Determine rumen microbial community constituents that impact the production of milk fat in dairy cows.

Eight lactating, ruminally cannulated, Holstein cows were housed in individual tie-stalls for use in the experiment. Cows were fed twice daily, milked twice a day, and had continuous access to fresh water. One cow (cow 4201) was removed from the study after the first dietary Milk Fat Depression due to complications arising from an abortion prior to the experiment.

Experimental Design and Treatment:

The experiment used a crossover design with 2 groups and 1 experimental period. The experimental period lasted 38 days: 10 days for the covariate/wash-out period and 28 days for data collection and sampling. The data collection period consisted of 10 days of dietary Milk Fat Depression (MFD) and 18 days of recovery. After the first experimental period, all cows underwent a 10-day wash out period prior to the beginning of period 2.

Dietary MFD was induced with a total mixed ration (TMR) low in fiber (29% NDF) with high starch degradability (70% degradable) and high polyunsaturated fatty acid levels (PUFA, 3.7%). The Recovery phase included two diets variable in starch degradability. Four cows were randomly assigned to the recovery diet high in fiber (37% NDF), low in PUFA (2.6%), and high in starch degradability (70% degradable). The remaining four cows were fed a recovery diet high in fiber (37% NDF), low in PUFA (2.6%), but low in starch degradability (35%).

During the 10-day covariate and 10-day wash out periods, cows were fed the high fiber, low PUFA, and low starch degradability diet.

Samples and Measurements:

Milk yield, dry matter intake, and feed efficiency were measured daily for each animal throughout the covariate, wash out, and sample collection periods. TMR samples were measured for nutrient composition. During the collection period, milk samples were collected and analyzed every 3 days. Samples were analyzed for milk component concentrations (milk fat, milk protein, lactose, milk urea nitrogen, somatic cell counts, and solids) and fatty acid compositions.

Rumen samples were collected and analyzed for microbial community composition and activity every 3 days during the collection period. The rumen was intensively sampled 0, 2, 4, 6, 8, 10, 12, 14, 16, 18, 20, and 22 hours after feeding during day 0, day 7, and day 10 of the dietary MFD. Similarly, the rumen was intensively sampled 0, 2, 4, 6, 8, 10, 12, 14, 16, 18, 20, and 22 hours after feeding on day 16 and day 28 of the sample collection period. Rumen contents were analyzed for pH, acetate concentration, butyrate concentration, propionate concentration, isoacid concentration, and long chain and CLA isomer concentrations. Rumen sampling included both particulate and fluid sampling from the center, dorsal, ventral, anterior, and posterior regions of the rumen through the cannula, and all five samples were pooled into 15 ml conical vials.

Rumen Sample Preparation and Sequencing:

After collection, rumen samples were centrifuged at 4,000 rpm in a swing bucket centrifuge for 20 minutes at 4° C. The supernatant was decanted, and an aliquot of each rumen content sample (1-2 mg) was added to a sterile 1.7 mL tube prefilled with 0.1 mm glass beads. A second aliquot was collected and stored in an empty, sterile 1.7 mL tube for cell counting.

Rumen samples in empty tubes were stained and put through a flow cytometer to quantify the number of cells of each microorganism type in each sample. Rumen samples with glass beads were homogenized with bead beating to lyse microorganisms. DNA and RNA was extracted and purified from each sample and prepared for sequencing on an Illumina Miseq. Samples were sequenced using paired-end chemistry, with 300 base pairs sequenced on each end of the library.

Sequencing Read Processing and Data Analysis:

Sequencing reads were quality trimmed and processed to identify bacterial species present in the rumen based on a marker gene, 16S rDNA, or ITS1 and/or ITS2. Count datasets and activity datasets were integrated with the sequencing reads to determine the absolute cell numbers of active microbial species within the rumen microbial community. Production characteristics of the cow over time, including pounds of milk produced, were linked to the distribution of active microorganisms within each sample over the course of the experiment using mutual information.

Tests cases to determine the impact of count data, activity data, and count and activity on the final output were run by omitting the appropriate datasets from the sequencing analysis. To assess the impact of using a linear correlation rather than the MIC on target selection, Pearson's coefficients were also calculated for pounds of milk fat produced as compared to the relative abundance of all microorganisms and the absolute abundance of active microorganisms.

Results

Figure 9:
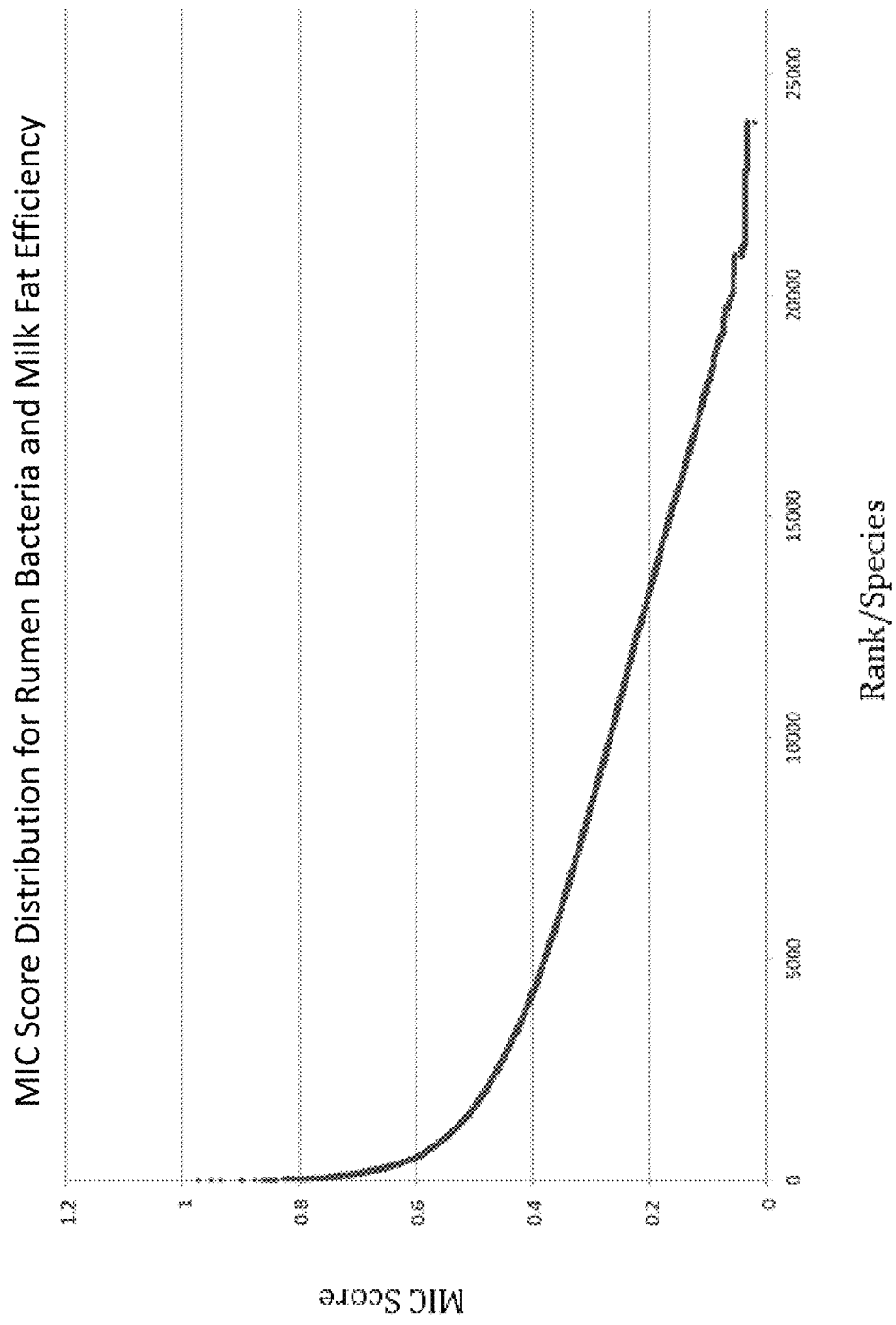
FIG. 9 depicts the MIC score distribution for rumen bacteria and milk fat efficiency.
Figure 10:
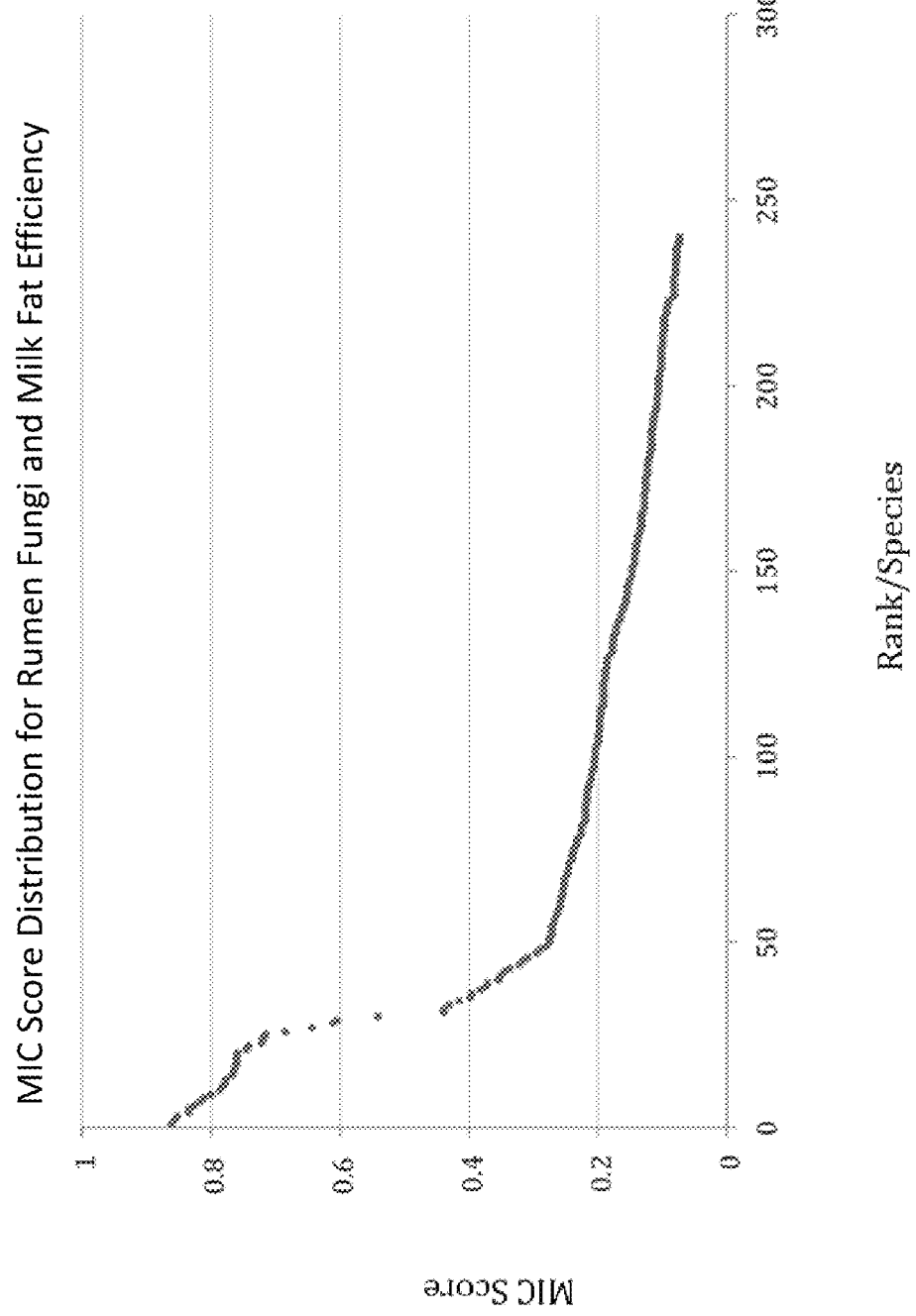
FIG. 10 depicts the MIC score distribution for rumen fungi and milk fat efficiency.
Figure 11:
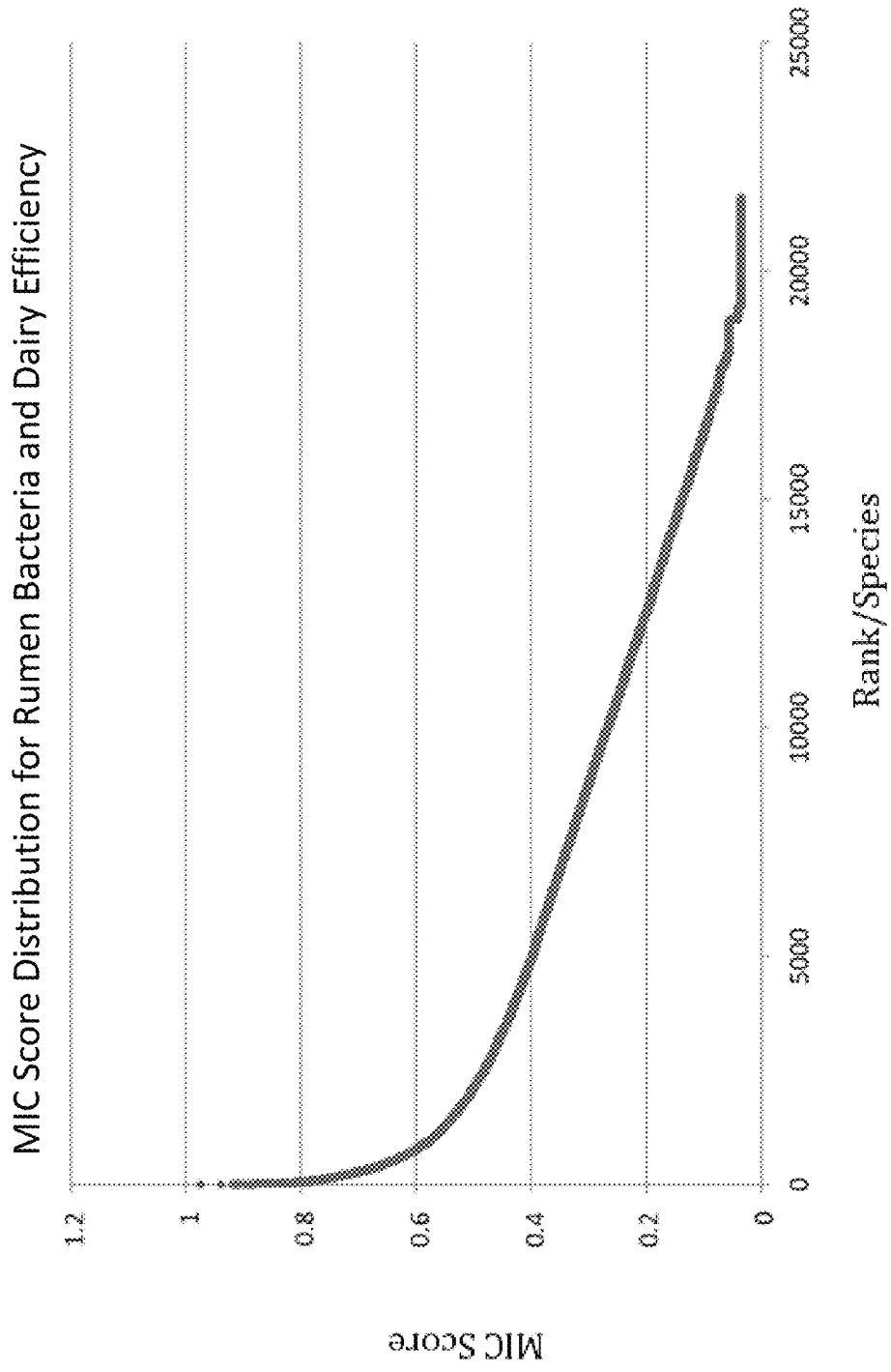
FIG. 11 depicts the MIC score distribution for rumen bacteria and dairy efficiency.
Figure 12:
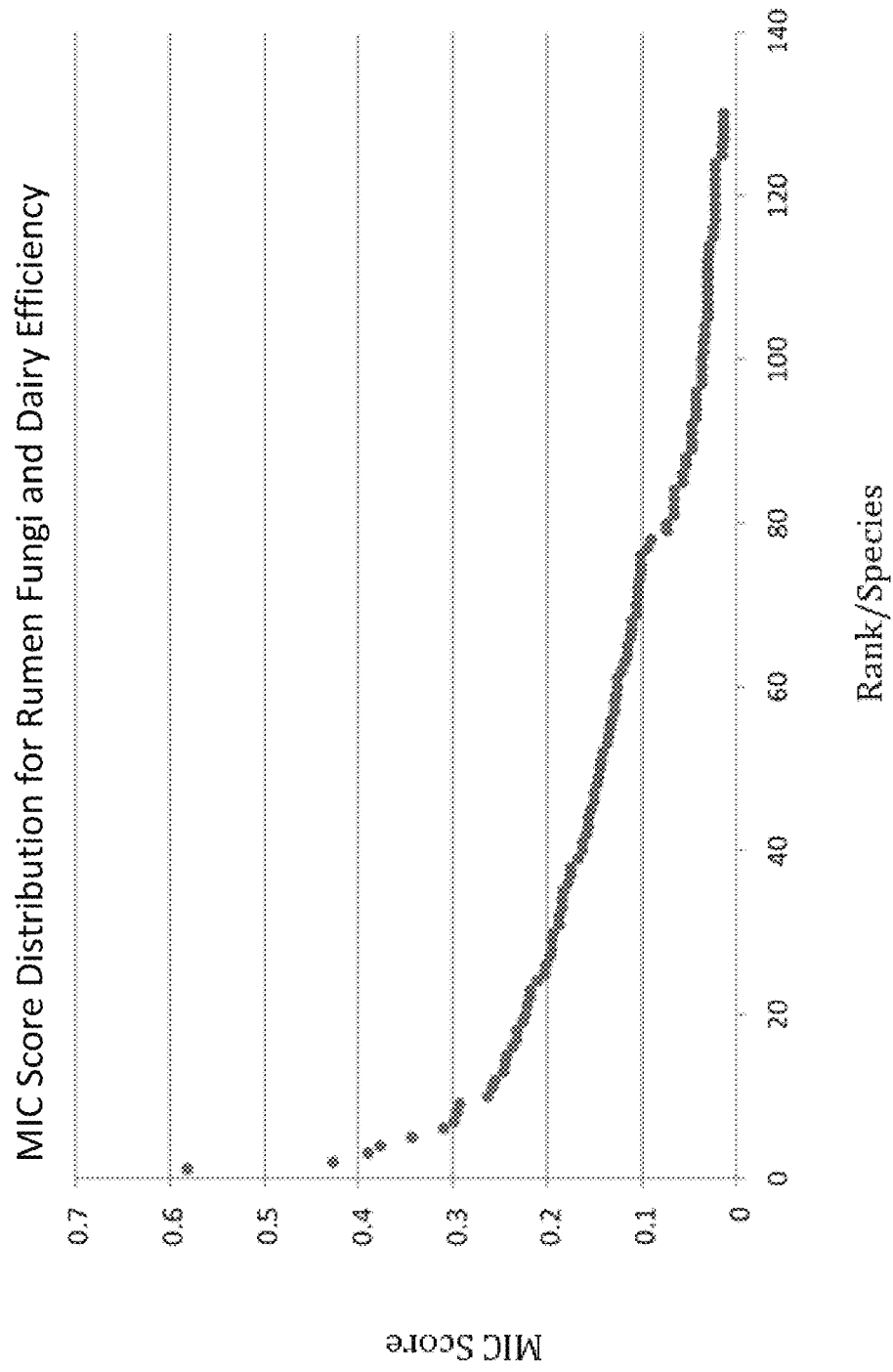
FIG. 12 depicts the MIC score distribution for rumen fungi and dairy efficiency.

One component of the Ascus Biosciences technology utilized in this application leverages mutual information to rank the importantce of native microbial strains residing in the gastrointestinal tract of the animal to specific animal traits. The maximal information coefficient (MIC) scores are calculated for all microorganisms and the desired animal trait. Relationships were scored on a scale of 0 to 1, with 1 representing a strong relationship between the microbial strain and the animal trait, and 0 representing no relationship. A cut-off based on this score is used to define useful and non-useful microorganisms with respect to the improvement of specific traits. FIG. 9 and FIG. 10 depict the MIC score distribution for rumen microbial strains that share a relationship with milk fat efficiency in dairy cows. The point where the curve shifts from exponential to linear (~0.45-0.5 for bacteria and ~0.3 for fungi) represents the cutoff between useful and non-useful microorganism strains pertaining to milk fat efficiency. FIG. 11 and FIG. 12 depict the MIC score distributions for rumen microbial strains that share a relationship with dairy efficiency. The point where the curve shifts from exponential to linear (~0.45-0.5 for bacteria and ~0.25 for fungi) represents the cutoff between useful and non-useful microorganism strains.

The MICs were calculated between pounds of milk fat produced and the absolute abundance of each active microorganism. Microorganisms were ranked by MIC score, and microorganisms with the highest MIC scores were selected as the target species most relevant to pounds of milk produced. MIC scores of the microbes of the present disclosure are recited in Table 1. The greater the MIC score, the greater the ability of the microbe to confer an increase in the weight of milk fat produced by a cow Example V. Comparative Analysis of MIC Scores From Published Work of Other Groups Utilizing Ascus Biosciences' technology, the performance of currently available microbial feed additive products was predicted.

Figure 13:
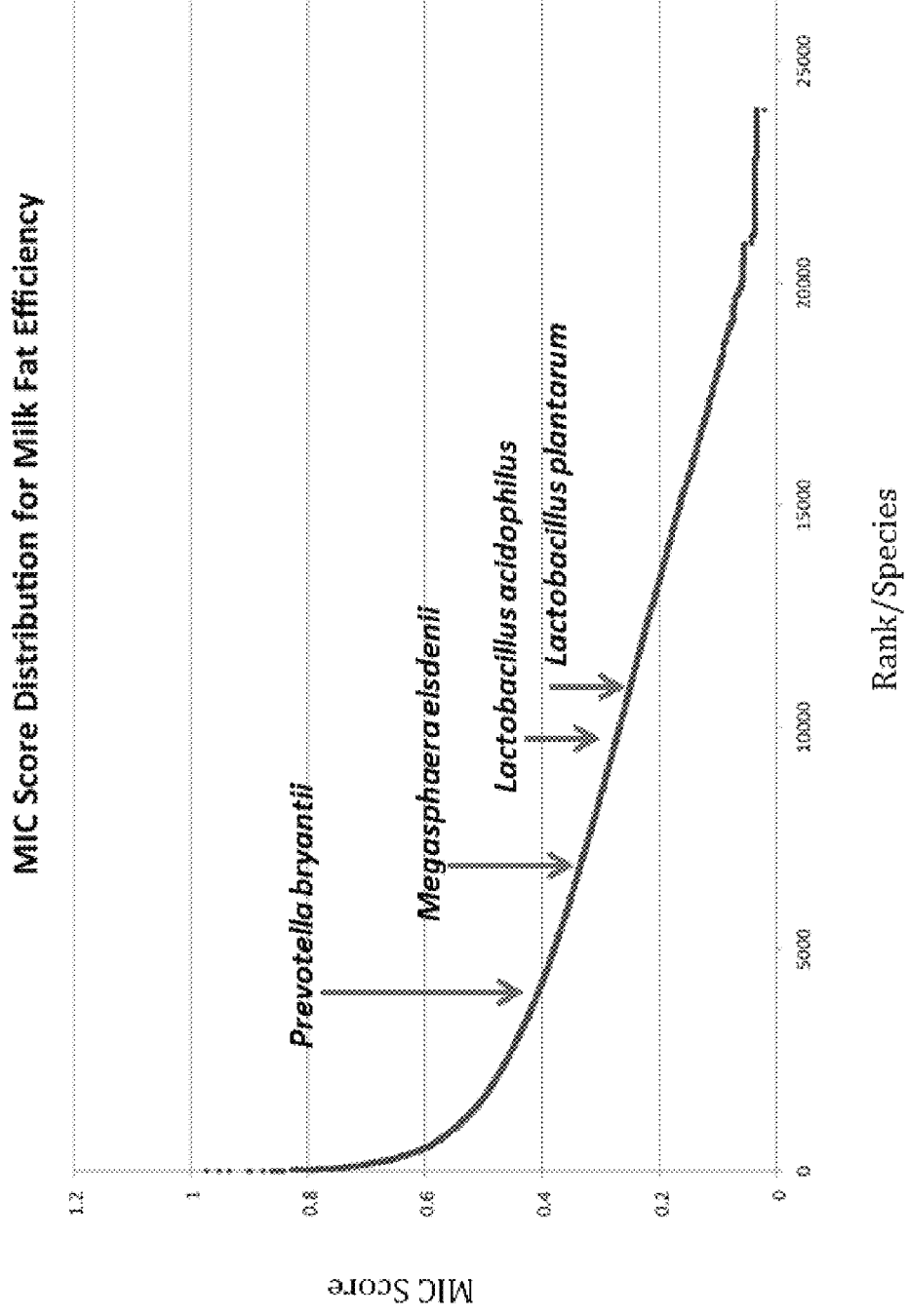
FIG. 13 depicts the MIC score distribution for rumen bacteria and milk fat efficiency with four species of bacteria and their MIC scores, in which the species have been evaluated in $3^{rd}$ party studies. The lower the MIC score, the less likely the species/strains are capable of positively modulating milk fat efficiency in dairy cows.

Direct-fed microbial products that claim to enhance dairy performance are openly available on the market. Some of these products contain microorganism strains that are native rumen microorganisms (*Megasphaera elsdenii*), or are within 97% sequence similarity of native rumen microorganisms. We have identified the species of microbes utilized in these products, and calculated their MIC score with respect to milk fat efficiency (FIG. 13). As evidenced by the curve in FIG. 13, all of the assayed strains that were available fell below the threshold used to define useful and non-useful strains, as describe above. The species/strain closest to the cutoff, *Prevotella bryantii*, has shown a positive effect in one study.

*Lactobacillus plantarum*: MIC 0.28402

The calculated MIC predicts that *Lactobacillus plantarum* is poorly associated with milk fat efficiency, and the art discloses that an inoculation of *L. plantarum* yields no increase in milk fat product, and at least one study discloses that some strains of *L. plantarum* create molecules that cause milk fat depression. See Lee et al. 2007. J. Appl. Microbiol. 103(4):1140-1146 and Mohammed et al. 2012. J. Dairy Sci. 95(1):328-339.

*Lactobacillus acidophilus*: MIC 0.30048

The calculated MIC predicts that *Lactobacillus acidophilus* is poorly associated with milk fat efficiency, and the art discloses that the administration of *L. acidophilus* to dairy cows/calves had no effect of various aspects of milk yield/milk component yield. See Higginbotham and Bath. 1993. J. Dairy Sci. 76(2):615-620; Abu-Tarboush et al. 1996. Animal Feed Sci. Tech. 57(1-2):39-49; McGilliard and Stallings. 1998. J. Dairy Sci. 81(5):1353-1357; and Raeth-Knight et al. 2007. J. Dairy Sci. 90(4):1802-1809; But see Boyd et al. 2011. 94(9):4616-4622 (discloses an increase in milk yield and milk protein yield). While Boyd et al. does disclose an increase in milk and milk protein yield, the controls of this single study do not appear to adequately isolate the the presence of *L. acidophilus* as the cause of the increase. The body of prior art contradicts the finding of Boyd et al.

*Megasphaera elsdenii*: MIC 0.32548

The calculated MIC predicts that *Megasphaera elsdenii* is poorly associated with milk fat efficiency, and the art provides substantial evidence to suggest that *Megasphaera elsdenii* has no positive effect upon milk fat efficiency, but multiple references provide evidence to suggest that it has a negative effect on milk fat efficiency. See Kim et al. 2002. J. Appl. Micro. 92(5):976-982; Hagg. 2008. Dissertation, University of Pretoria. 1-72; Hagg et al. 2010. S. African. J. Animal Sci. 40(2):101-112; Zebeli et al. 2011. J. Dairy Res. 79(1):16-25; Aikman et al. 2011. J. Dairy Sci. 94(6):2840-2849; Mohammed et al. 2012. J. Dairy Sci. 95(1):328-339; and Cacite and Weimer. 2016. J. Animal Sci. Poster Abstract. 94(sup. 5):784.

*Prevotella bryantii*: MIC 0.40161

The calculated MIC predicts that *Prevotella bryantii* is not highly associated with milk fat efficiency, and the art provides evidence that *P. bryantii* administered during subacute acidosis challenge in midlactation dairy cows has no apparent effect on milk yield, whereas administration of the microbe to dairy cows in early lactation yields improved milk fat concentrations. See Chiquette et al. 2012. J. Dairy Sci. 95(10):5985-5995, but see Chiquette et al. 2008. 91(9): 3536-3543; respectively.

Example VI. Shift in Rumen Microbial Composition after Administration of a Microbial Composition The methods of the instant example aim to increase the total amount of milk fat and milk protein produced by a lactating ruminant, and the calculated energy corrected milk (ECM).

The methodologies presented herein—based upon utilizing the disclosed isolated microbes, consortia, and compositions comprising the same—demonstrate an increase in the total amount of milk fat and milk protein produced by a lactating ruminant. These increases were realized without the need for further addition of hormones.

In this example, a microbial consortium comprising two isolated microbes, Ascusb_3138 (SEQ ID NO:28) and Ascusf_15 (SEQ ID NO:32), was administered to Holstein cows in mid-stage lactation over a period of five weeks.

The cows were randomly assigned into 2 groups of 8, in which one of the groups was a control group that received a buffer lacking a microbial consortium. The second group, the experimental group, was administered a microbial consortium comprising Ascusb_3138 (SEQ ID NO:28) and Ascusf_15 (SEQ ID NO:32) once per day for five weeks. Each cow was housed in an individual pen and was given free access to feed and water. The diet was a high milk yield diet. Cows were fed ad libitum and the feed was weighed at the end of each day, and prior day refusals were weighed and discarded. Weighing was performed with a PS-2000 scale from Salter Brecknell (Fairmont, Minn.).

Cows were cannulated such that a cannula extended into the rumen of the cows. Cows were further provided at least 10 days of recovery post cannulation prior to administering control dosages or experimental dosages.

Each administration consisted of 20 ml of a neutral buffered saline, and each administration consisted of approximately $10^9$ cells suspended in the saline. The control group received 20 ml of the saline once per day, while the experimental group received 20 ml of the saline further comprising $10^9$ microbial cells of the described microbial consortium.

The rumen of every cow was sampled on days 0, 7, 14, 21, and 35, wherein day 0 was the day prior to microbial administration. Note that the experimental and control administrations were performed after the rumen was sampled on that day. Daily sampling of the rumen, beginning on day 0, with a pH meter from Hanna Instruments (Woonsocket, R.I.) was inserted into the collected rumen fluid for recordings. Rumen sampling included both particulate and fluid sampling from the center, dorsal, ventral, anterior, and posterior regions of the rumen through the cannula, and all five samples were pooled into 15 ml conical vials containing 1.5 ml of stop solution (95% ethanol, 5% phenol) and stored at 4° C. and shipped to Ascus Biosciences (Vista, Calif.) on ice.

A portion of each rumen sample was stained and put through a flow cytometer to quantify the number of cells of each microorganism type in each sample. A separate portion of the same rumen sample was homogenized with bead beating to lyse microorganisms. DNA and RNA was extracted and purified from each sample and prepared for sequencing on an Illumina Miseq. Samples were sequenced using paired-end chemistry, with 300 base pairs sequenced on each end of the library. The sequencing reads were used to quantify the number of cells of each active, microbial member present in each animal rumen in the control and experimental groups over the course of the experiment.

Ascusb_3138 and Ascusf_15 both colonized, and were active in the rumen after ~3-5 days of daily administration, depending on the animal. This colonization was observed in the experimental group, but not in the control group. The rumen is a dynamic environment, where the chemistry of the cumulative rumen microbial population is highly intertwined. The artificial addition of Ascusb_3138 and Ascuf_15 could have effects on the overall structure of the community. To assess this potential impact, the entire microbial community was analyzed over the course of the experiment to identify higher level taxonomic shifts in microbial community population.

Distinct trends were not observed in the fungal populations over time, aside from the higher cell numbers of Ascusf_15 in the experimental animals. The bacterial populations, however, did change more predictably. To assess high level trends across individual animals over time, percent compositions of the microbial populations were calculated and compared. See Table 13. Only genera composing greater than 1% of the community were analyzed. The percent composition of genera containing known fiber-degrading bacteria, including *Ruminococcus*, was found to increase in experimental animals as compared to control animals. Volatile fatty acid-producing genera, including Clostridial cluster XIVa, *Clostridium, Pseudobutyrivibrio, Butyricimonas*, and *Lachnospira* were also found at higher abundances in the experimental animals. The greatest shift was observed in the genera *Prevotella*. Members of this genus have been shown to be involved in the digestion of cellobiose, pectin, and various other structural carbohydrates within the rumen. *Prevotella* sp. have further been implicated in the conversion of plant lignins into beneficial antioxidants (Schogor et al. PLOS One. 9(4):e87949 (10 p.)).

To more directly measure quantitative changes in the rumen over time, cell count data was integrated with sequencing data to identify bulk changes in the population at the cell level. Fold changes in cell numbers were determined by dividing the average number of cells of each genera in the experimental group by the average number of cells of each genera in the control group. See Table 13. The cell count analysis captured many genera that fell under the threshold in the previous analysis *Promicromonospora, Rhodopirellula, Olivibacter, Victivallis, Nocardia, Lentisphaera, Eubacteiru, Pedobacter, Butyricimonas, Mogibacterium*, and *Desulfovibrio* were all found to be at least 10 fold higher on average in the experimental animals. *Prevotella, Lachnospira, Butyricicoccus, Clostridium* XIVa, *Roseburia, Clostridium_sensu_stricto*, and *Pseudobutyrivibrio* were found to be ~1.5 times higher in the experimental animals.

TABLE 13

Family and Genus Level Analysis of Shifts in Bacterial Populations

| Taxonomy | Control (%) | Variation | Experimental (%) | Variation |
|---|---|---|---|---|
| Family Level Analysis | | | | |
| Prevotellaceae | 15.27 | 6.43 | 18.62 | 5.63 |
| Ruminococcaceae | 16.40 | 5.14 | 17.84 | 6.44 |
| Lachnospiraceae | 23.85 | 7.63 | 24.58 | 6.96 |
| Genus Level Analysis | | | | |
| *Prevotella* | 16.14 | 5.98 | 19.14 | 5.27 |
| Clostridium_XIVa | 12.41 | 5.35 | 12.83 | 4.81 |
| Lachnospiracea_incertae_sedis | 3.68 | 1.68 | 3.93 | 1.33 |
| *Ruminococcus* | 3.70 | 2.21 | 3.82 | 1.82 |
| Clostridium_IV | 3.02 | 1.87 | 3.51 | 1.74 |
| *Butyricimonas* | 1.68 | 1.35 | 1.83 | 2.38 |
| Clostridium_sensu_stricto | 1.52 | 0.65 | 1.81 | 0.53 |
| *Pseudobutyrivibrio* | 1.00 | 0.64 | 1.42 | 1.03 |
| *Citrobacter* | 0.71 | 1.86 | 1.95 | 3.00 |
| *Selenomonas* | 1.04 | 0.83 | 1.34 | 0.86 |
| *Hydrogenoanaerobacterium* | 1.03 | 1.08 | 1.11 | 0.78 |

TABLE 14

Analysis of Fold Changes in Bacterial cells

| Genus | Fold change (experimental/control) |
|---|---|
| *Promicromonospora* | 22619.50 |
| *Rhodopirellula* | 643.31 |
| *Olivibacter* | 394.01 |
| *Victivallis* | 83.97 |
| *Nocardia* | 73.81 |
| *Lentisphaera* | 57.70 |
| *Eubacterium* | 50.19 |
| *Pedobacter* | 26.15 |
| *Butyricimonas* | 15.47 |
| *Mogibacterium* | 15.23 |
| *Desulfovibrio* | 13.55 |
| *Anaeroplasma* | 8.84 |
| *Sharpea* | 8.78 |
| Erysipelotrichaceae_incertae_sedis | 5.71 |
| *Saccharofermentans* | 5.09 |
| *Parabacteroides* | 4.16 |
| *Papillibacter* | 3.63 |

TABLE 14-continued

Analysis of Fold Changes in Bacterial cells

| Genus | Fold change (experimental/control) |
|---|---|
| Citrobacter | 2.95 |
| Lachnospiracea_incertae_sedis | 2.27 |
| Prevotella | 1.60 |
| Butyricicoccus | 1.95 |
| Clostridium_XIVa | 1.47 |
| Roseburia | 1.44 |
| Pseudobutyrivibrio | 1.43 |
| Clostridium_sensu_stricto | 1.29 |
| Selenomonas | 1.25 |
| Olsenella | 1.04 |

Example VII. Analysis of Rumen Microbes for Volatile Fatty Acid Production and Carbon Source Use A. Volatile Fatty Acid (VFA) Production To assess the ability of the strains to produce volatile fatty acids, High Performance Liquid Chromatography (HPLC) was utilized to measure the conventration sof acetate, butyrate, and propionate in spent media. M2GSC media was used in an assay mimicking rumen conditions as closely as possibile.

For pure cultures, a single colony from each of the desired strains (from anaerobic agar plates) was inoculated into M2GSC media. A medium blank (control) was also prepared. Cultures and the medium blank were incubated at 37° C. until significant growth was visible. An optical density (OD600) was determined for each culture, and the strain ID was confirmed with Illumina sequencing. An aliquot of culture was subjected to sterile filtration into a washed glass 15 ml sample vial and analyzed by HPLC; HPLC assays were performed at Michigan State University. Enrichments that exhibited growth were also stained and cell counted to confirm that the individual strains within each enrichment grew. Strains often appeared in multiple enrichments, so the enrichment with the highest amount of growth for the strain (i.e. the highest increase in cell number of that strain) is reported in Table 15.

Due to the vast complexity of metabolisms and microbial lifestyles present in the rumen, many rumen microorganisms are incapable of axenic growth. In order to assay these organisms for desirable characteristics, enrichments cultures were established under a variety of conditions that mimicked particular features of the rumen environment. Diluted rumen fluid (1/100 dilution) was inoculated into M2GSC or M2 media supplemented with a variety of carbon sources including xylose (4 g/L), mannitol (4 g/L), glycerol (4 g/L), xylan (2 g/L), cellobiose (2 g/L), arabinose (4 g/L), mannose (4 g/L), rhaminose (2 g/L), maltose (2 g/L), maltose (2 g/L), and molasses. Rumen fluid was also sometimes omitted from the recipe. Additions including amino acids, volatile fatty acids, and antibiotics, were also varied across the enrichments. A medium blank (control) was also prepared. Cultures and the medium blank were incubated at 37° C. until significant growth was visible. An optical density (OD600) was determined for each culture, and the strain IDs were confirmed with Illumina sequencing. An aliquot of culture was subjected to sterile filtration into a washed glass 15 ml sample vial and analyzed by HPLC; HPLC assays were performed at Michigan State University. Enrichments that exhibited growth were also stained and cell counted to confirm that the individual strains within each enrichment grew. Strains often appeared in multiple enrichments, so the enrichment with the highest amount of growth for the strain (i.e, the highest increase in cell number of that strain) is reported in Table 15.

Concentrations of acetate, butyrate, and propionate were quantified for the medium blanks as well as the sterile filtered culture samples for both pure strain and enrichment experiments. HPLC parameters were as follows: Biorad Aminex HPX-87H column, 60° C., 0.5 ml/minute mobile phase 0.00325 N $H_2SO_4$, 500 psi, 35C RI detector, 45 minute run time, and 5 µL injection volume. Concentrations of acetate, butyrate, and propionate for both pure cultures and enrichments are reported in Table 15.

TABLE 15

Volatile Fatty Acid Production of Microbial Strains as Analyzed with HPLC, Normalized to 1 OD

| Sample ID | Acetate (g/L) | Propionate (g/L) | Butyrate (g/L) |
|---|---|---|---|
| Ascusb_5 | 3.59 | 0.00 | 0.00 |
| Ascusb_7 | 1.54 | 4.08 | 0.03 |
| Ascusb_11 | −6.88 | −0.28 | −0.04 |
| Ascusb_26 | 6.10 | 7.57 | 1.38 |
| Ascusb_27 | 0.59 | 1.48 | 4.98 |
| Ascusb_32 | 6.10 | 7.57 | 1.38 |
| Ascusb_36 | 4.30 | 0.68 | 0.00 |
| Ascusb_79 | 2.00 | 0.00 | 0.00 |
| Ascusb_82 | 6.10 | 7.57 | 1.38 |
| Ascusb_89 | 1.69 | 4.20 | 0.27 |
| Ascusb_101 | 1.45 | −0.21 | 0.00 |
| Ascusb_102 | 2.00 | 0.00 | 0.00 |
| Ascusb_104 | 27.13 | 34.55 | 3.31 |
| Ascusb_111 | 1.69 | 4.20 | 0.27 |
| Ascusb_119 | 1.54 | 4.08 | 0.03 |
| Ascusb_125 | 10.97 | 5.68 | 4.69 |
| Ascusb_145 | 1.69 | 4.20 | 0.27 |
| Ascusb_149 | 0.00 | 0.00 | 0.47 |
| Ascusb_159 | 7.05 | 4.52 | 1.42 |
| Ascusb_183 | 0.00 | 0.00 | 2.03 |
| Ascusb_187 | 10.97 | 5.68 | 4.69 |
| Ascusb_190 | 7.40 | 7.36 | 7.91 |
| Ascusb_199 | 11.36 | 1.17 | 7.65 |
| Ascusb_205 | 6.10 | 7.57 | 1.38 |
| Ascusb_232 | 7.83 | 1.15 | 3.19 |
| Ascusb_268 | 2.00 | 0.00 | 0.00 |
| Ascusb_278 | 7.05 | 4.52 | 1.42 |
| Ascusb_329 | 7.83 | 1.15 | 3.19 |
| Ascusb_368 | 1.69 | 4.20 | 0.27 |
| Ascusb_374 | 7.83 | 1.15 | 3.19 |
| Ascusb_411 | 1.69 | 4.20 | 0.27 |
| Ascusb_546 | 4.30 | 0.68 | 0.00 |
| Ascusb_728 | 2.36 | 0.00 | 0.00 |
| Ascusb_765 | −11.63 | 0.00 | 0.00 |
| Ascusb_810 | 1.54 | 4.08 | 0.03 |
| Ascusb_812 | 2.00 | 0.00 | 0.00 |
| Ascusb_817 | 1.16 | 0.00 | 0.09 |
| Ascusb_826 | 0.42 | 0.00 | 0.51 |
| Ascusb_880 | −0.12 | 0.00 | 0.00 |
| Ascusb_913 | 10.97 | 5.68 | 4.69 |
| Ascusb_974 | 4.30 | 0.68 | 0.00 |
| Ascusb_1069 | 0.00 | 0.00 | 2.32 |
| Ascusb_1074 | 7.05 | 4.52 | 1.42 |
| Ascusb_1295 | 1.54 | 4.08 | 0.03 |
| Ascusb_1367 | 7.40 | 7.36 | 7.91 |
| Ascusb_1632 | 1.54 | 4.08 | 0.03 |
| Ascusb_1674 | 0.68 | 0.30 | 0.00 |
| Ascusb_1763 | 1.69 | 4.20 | 0.27 |
| Ascusb_1780 | 1.32 | 0.00 | 0.21 |
| Ascusb_1786 | 1.69 | 4.20 | 0.27 |

TABLE 15-continued

Volatile Fatty Acid Production of Microbial Strains as Analyzed with HPLC, Normalized to 1 OD

| Sample ID | Acetate (g/L) | Propionate (g/L) | Butyrate (g/L) |
|---|---|---|---|
| Ascusb_1801 | 5.47 | 26.95 | −0.60 |
| Ascusb_1812 | 1.54 | 4.08 | 0.03 |
| Ascusb_1833 | 7.83 | 1.15 | 3.19 |
| Ascusb_1850 | 1.32 | 0.00 | 0.21 |
| Ascusb_2090 | 1.54 | 4.08 | 0.03 |
| Ascusb_2124 | 1.69 | 4.20 | 0.27 |
| Ascusb_2511 | 0.00 | 0.00 | 0.11 |
| Ascusb_2530 | 11.36 | 1.17 | 7.65 |
| Ascusb_2597 | 4.30 | 0.68 | 0.00 |
| Ascusb_2624 | 0.00 | 0.00 | 0.00 |
| Ascusb_2667 | 3.16 | 1.46 | 1.02 |
| Ascusb_2836 | 1.32 | 0.00 | 0.21 |
| Ascusb_3003 | 0.00 | 0.00 | 0.11 |
| Ascusb_3138 | 0.00 | 0.00 | 2.50 |
| Ascusb_3504 | 1.69 | 4.20 | 0.27 |
| Ascusb_3881 | 7.05 | 4.52 | 1.42 |
| Ascusb_6589 | 5.47 | 26.95 | −0.60 |
| Ascusb_12103 | 0.94 | 0.00 | 0.00 |
| Ascusb_14245 | 1.76 | 0.00 | 0.00 |
| Ascusb_20083 | 27.13 | 34.55 | 3.31 |
| Ascusb_20187 | 7.40 | 7.36 | 7.91 |

B. Soluble Carbon Source Assay

To assess the ability of the strains to degrade various carbon sources, an optical density (OD600) was used to measure growth of strains on multiple carbon sources over time.

For pure isolates, a single colony from each of the desired strains (from anaerobic agar plates) was inoculated into M2GSC media. A medium blank (control) was also prepared. Strains were inoculated into a carbon source assay anaerobically, wherein the assay was set up in a 2 mL sterile 96-well plate, with each well containing RAMM salts, vitamins, minerals, cysteine, and a single carbon source. Carbon sources included glucose, xylan, lactate, xylose, mannose, glycerol, pectin, molasses, and cellobiose. Cells were inoculated such that each well started at an OD600 of 0.01. Optican densities were read at 600 nm with the Synergy H4 hybrid plate reader. The strain IDs were confirmed with Illumina sequencing after all wells were in stationary phase.

As in the volatile fatty acid assay above, enrichments were also used to assay carbon source degradation. Diluted rumen fluid (1/100 dilution) was inoculated into M2GSC or M2 media supplemented with a variety of carbon sources including xylose (4 g/L), mannitol (4 g/L), glycerol (4 g/L), xylan (2 g/L), cellobiose (2 g/L), arabinose (4 g/L), mannose (4 g/L), rhaminose (2 g/L), maltose (2 g/L), maltose (2 g/L), and molasses. Rumen fluid was also sometimes omitted from the recipe. Additions including amino acids, volatile fatty acids, and antibiotics, were also varied across the enrichments. A medium blank (control) was also prepared. Cultures and the medium blank were incubated at 37° C. until significant growth was visible. An optical density (OD600) was determined for each culture, and the strain IDs were confirmed with Illumina sequencing. Enrichments that exhibited growth were also stained and cell counted to confirm that the individual strains within each enrichment grew.

C. Insoluble Carbon Source Assay

To assess the ability of the strains to degrade insoluble carbon sources, visual inspection was leveraged to qualitatively determine a strain's degradation capabilities.

For pure cultures, a single colony from each of the desired strains (from anaerobic agar plates) was inoculated into anaerobic Hungate tubes containing Lowe's semi defined media with cellulose paper, starch, or grass as the sole carbon source. (Lowe et al. 1985. J. Gen. Microbiol. 131: 2225-2229). Enrichment cultures using a 1/100 dilutiopn of rumen fluid were also set up using the same medium conditions. Cultures were checked visually for degradation of insoluble carbon sources (See FIG. 14). Strain ID was confirmed using Illumina sequencing. Enrichments that exhibited growth were also stained and cell counted to confirm that the individual strains within each enrichment grew.

TABLE 16

Analysis of Degradation of Various Soluable and Non-Soluable Carbon Sources by Strains of the Present Disclosure

| Strain ID | D-Glucose | Xylan | Lactate | D-Xylose | D-Mannose | Glycerol | Pectin | Molasses | Cellobiose | Cellulose | Starch |
|---|---|---|---|---|---|---|---|---|---|---|---|
| Ascusb_5 | + | + | − | + | + | + | + | − | + | Unknown | Unknown |
| Ascusb_7 | + | − | + | − | − | + | − | − | + | Unknown | Unknown |
| Ascusb_11 | − | − | − | + | − | + | + | + | + | Unknown | Unknown |
| Ascusb_26 | + | − | + | − | − | + | − | − | + | Unknown | Unknown |
| Ascusb_27 | + | − | − | − | − | − | − | − | − | Unknown | Unknown |
| Ascusb_32 | + | − | + | − | + | + | − | − | + | Unknown | Unknown |
| Ascusb_36 | − | + | − | − | − | + | − | − | − | Unknown | Unknown |
| Ascusb_79 | + | − | − | − | − | + | − | − | + | Unknown | Unknown |
| Ascusb_82 | + | + | + | + | − | + | − | − | + | Unknown | Unknown |
| Ascusb_89 | + | − | − | − | − | + | − | − | − | Unknown | Unknown |
| Ascusb_101 | − | − | + | − | − | + | − | − | − | Unknown | Unknown |
| Ascusb_102 | + | + | + | − | − | + | − | − | − | Unknown | Unknown |
| Ascusb_104 | − | − | + | − | − | − | − | − | − | Unknown | Unknown |
| Ascusb_111 | − | + | − | − | − | + | − | − | + | Unknown | Unknown |
| Ascusb_119 | − | − | − | + | − | + | − | − | − | Unknown | Unknown |
| Ascusb_125 | − | − | + | + | − | + | − | + | − | Unknown | Unknown |
| Ascusb_145 | + | − | − | − | − | + | − | − | − | Unknown | Unknown |
| Ascusb_149 | + | − | − | − | + | + | − | + | − | Unknown | Unknown |
| Ascusb_159 | + | − | + | + | − | + | − | + | − | Unknown | Unknown |
| Ascusb_183 | + | − | − | + | − | + | − | + | + | Unknown | Unknown |
| Ascusb_187 | + | + | − | + | − | + | − | + | − | Unknown | Unknown |
| Ascusb_190 | + | − | + | − | − | + | − | + | − | Unknown | Unknown |
| Ascusb_199 | − | − | − | + | − | + | − | − | − | Unknown | Unknown |

TABLE 16-continued

Analysis of Degradation of Various Soluable and Non-Soluable Carbon Sources by Strains of the Present Disclosure

| Strain ID | D-Glucose | Xylan | Lactate | D-Xylose | D-Mannose | Glycerol | Pectin | Molasses | Cellobiose | Cellulose | Starch |
|---|---|---|---|---|---|---|---|---|---|---|---|
| Ascusb_205 | − | − | + | − | − | + | − | − | − | Unknown | Unknown |
| Ascusb_232 | − | − | − | + | − | + | − | − | − | Unknown | Unknown |
| Ascusb_268 | − | − | − | − | − | + | − | − | − | Unknown | Unknown |
| Ascusb_278 | − | − | − | − | − | + | − | + | + | Unknown | Unknown |
| Ascusb_329 | − | − | − | + | − | − | − | − | − | Unknown | Unknown |
| Ascusb_368 | − | − | − | − | − | + | − | − | − | Unknown | Unknown |
| Ascusb_374 | + | − | − | + | + | + | − | − | + | Unknown | Unknown |
| Ascusb_411 | − | + | − | − | − | − | − | − | − | Unknown | Unknown |
| Ascusb_546 | − | + | − | − | − | + | − | − | − | Unknown | Unknown |
| Ascusb_728 | + | − | − | + | + | + | − | − | + | Unknown | Unknown |
| Ascusb_765 | − | − | − | − | − | + | − | − | + | Unknown | Unknown |
| Ascusb_810 | + | − | − | − | − | + | − | − | − | Unknown | Unknown |
| Ascusb_812 | − | − | + | − | − | − | − | − | − | Unknown | Unknown |
| Ascusb_817 | − | − | + | − | + | + | − | − | + | Unknown | Unknown |
| Ascusb_826 | + | − | − | + | − | + | − | − | + | Unknown | Unknown |
| Ascusb_880 | + | − | − | + | − | + | − | + | + | Unknown | Unknown |
| Ascusb_913 | + | + | − | + | − | + | − | + | − | Unknown | Unknown |
| Ascusb_974 | − | + | − | − | − | + | − | − | − | Unknown | Unknown |
| Ascusb_1069 | − | − | − | − | − | − | − | − | + | Unknown | Unknown |
| Ascusb_1074 | − | + | + | − | − | + | − | − | − | Unknown | Unknown |
| Ascusb_1295 | + | − | − | − | + | + | − | − | + | Unknown | Unknown |
| Ascusb_1367 | + | + | − | − | − | + | − | + | + | Unknown | Unknown |
| Ascusb_1632 | − | − | − | − | − | + | − | − | − | Unknown | Unknown |
| Ascusb_1674 | + | − | − | + | + | − | + | − | + | Unknown | Unknown |
| Ascusb_1763 | + | − | − | − | − | + | − | − | − | Unknown | Unknown |
| Ascusb_1780 | − | − | − | − | + | + | − | − | + | Unknown | Unknown |
| Ascusb_1786 | + | − | − | − | − | − | − | − | − | Unknown | Unknown |
| Ascusb_1801 | − | − | + | − | − | + | − | − | − | Unknown | Unknown |
| Ascusb_1812 | + | − | − | − | − | − | − | − | − | Unknown | Unknown |
| Ascusb_1833 | − | + | + | + | + | + | − | − | + | Unknown | Unknown |
| Ascusb_1850 | − | − | − | − | + | + | − | − | + | Unknown | Unknown |
| Ascusb_2090 | + | − | − | − | − | − | − | − | + | Unknown | Unknown |
| Ascusb_2124 | + | − | − | − | − | − | − | − | − | Unknown | Unknown |
| Ascusb_2511 | − | + | − | + | − | + | − | − | + | Unknown | Unknown |
| Ascusb_2530 | + | − | − | − | − | + | − | − | − | Unknown | Unknown |
| Ascusb_2597 | − | + | − | − | − | + | − | − | − | Unknown | Unknown |
| Ascusb_2624 | − | − | − | − | − | + | − | − | − | Unknown | Unknown |
| Ascusb_2667 | + | − | − | − | − | + | − | − | + | Unknown | Unknown |
| Ascusb_2836 | − | − | − | − | + | + | − | − | + | Unknown | Unknown |
| Ascusb_3003 | + | − | − | + | − | − | − | − | + | Unknown | Unknown |
| Ascusb_3138 | + | − | + | − | − | + | − | + | + | Unknown | Unknown |
| Ascusb_3504 | + | − | − | − | − | + | − | − | − | Unknown | Unknown |
| Ascusb_3881 | − | + | − | − | − | + | − | − | − | Unknown | Unknown |
| Ascusb_6589 | − | − | + | − | − | − | − | − | − | Unknown | Unknown |
| Ascusb_12103 | + | − | − | − | − | − | − | − | + | Unknown | Unknown |
| Ascusb_14245 | + | − | − | − | − | + | − | − | + | Unknown | Unknown |
| Ascusb_20083 | − | − | + | − | − | + | − | − | − | Unknown | Unknown |
| Ascusb_20187 | + | − | − | − | − | + | − | − | − | Unknown | Unknown |
| Ascusf_15 | + | + | Unknown | + | + | Unknown | + | + | + | + | + |
| Ascusf_22 | − | − | Unknown | − | − | Unknown | − | Unknown | − | + | − |
| Ascusf_23 | + | − | Unknown | − | − | Unknown | − | Unknown | + | + | − |
| Ascusf_24 | − | − | Unknown | − | − | Unknown | − | Unknown | − | + | − |
| Ascusf_25 | + | − | Unknown | − | − | Unknown | − | Unknown | + | − | − |
| Ascusf_38 | − | − | Unknown | − | − | Unknown | − | Unknown | − | + | − |
| Ascusf_45 | + | − | Unknown | − | − | Unknown | − | Unknown | + | + | + |
| Ascusf_77 | + | − | Unknown | + | − | Unknown | − | Unknown | + | + | + |
| Ascusf_94 | + | + | Unknown | + | − | Unknown | − | Unknown | + | + | + |
| Ascusf_108 | + | − | Unknown | − | − | Unknown | − | Unknown | + | − | − |
| Ascusf_206 | − | − | Unknown | − | − | Unknown | − | Unknown | − | + | − |
| Ascusf_208 | − | − | Unknown | − | − | Unknown | − | Unknown | − | + | − |
| Ascusf_307 | + | − | Unknown | − | − | Unknown | − | Unknown | + | + | + |
| Ascusf_334 | + | + | Unknown | + | + | Unknown | − | Unknown | + | + | + |
| Ascusf_353 | + | − | Unknown | + | − | Unknown | − | Unknown | + | − | − |
| Ascusf_1012 | − | − | Unknown | − | − | Unknown | − | Unknown | − | + | − |

TABLE 17

M2GSC and M2 Media Recipes

| M2GSC | | M2 | |
|---|---|---|---|
| Component | Amount | Component | Amount |
| Beef Extract | 5 g | NaHCO$_3$ | 4 g |
| Yeast Extract | 1.25 g | HCl-L-cysteine | 0.3 g |
| NaHCO$_3$ | 2 g | (NH$_4$)$_2$SO$_4$ | 0.10 g |
| Cellobiose | 1 g | MgSO$_4$7H$_2$O | 0.005 g |
| Starch | 1 g | K$_2$HPO$_4$ | 0.05 g |
| Glucose | 1 g | KH$_2$PO$_4$ | 0.05 g |
| (NH$_4$)$_2$SO$_4$ (1M) | 2.55 mL | DI H$_2$O | Up to 1000 mL |
| MgSO$_4$7H$_2$O (0.25M) | 0.288 mL | | |
| K$_2$HPO$_4$ (1M) | 1 mL | | |
| KH$_2$PO$_4$ (1M) | 1.275 mL | | |
| Clarified Rumen Fluid | 50 mL | | |
| HCl-L-cysteine | 0.3 g | | |
| DI H$_2$O | Up to 500 mL | | |

TABLE 18

Modified Wolfe's Media Recipes

| 250X Modified Wolfe's Vitamin Mix | | Modified Wolfe's Mineral Solution | |
|---|---|---|---|
| Component | g/200 mL | Component | g/L |
| Pyridoxine-HCl | 0.5 | MgSO$_4$ 7H$_2$O | 140 |
| p-Aminobenzoic | 0.25 | Nitrilotriacetic acid | 10.96 |
| Lipoic Acid | 0.216 | NaCl | 50.06 |
| Nicotinic Acid | 0.252 | MnSO$_4$ H$_2$O | 24.99 |
| Riboflavin | 0.013 | CaCl$_2$ | 5 |
| Thiamine HCL | 0.25 | CoCl$_2$ 6H$_2$O | 4.997 |
| Calcium - DL - Pantothenate | 0.1 | FeSO$_2$ 7H$_2$O | 4.997 |
| Biotin | 0.044 | ZnSO$_2$ 7H$_2$O | 5.003 |
| Folic Acid | 0.004 | AlK(SO$_4$)$_2$ 12 H$_2$O | 0.5 |
| Vitamin B12 | 0.007 | CuSO$_4$ 5H$_2$O | 0.499 |
| | | H$_3$BO$_3$ | 0.498 |
| | | NaMoO$_4$ 2H$_2$O | 0.503 |
| | | DI H$_2$O | 1 L |

All media was prepared with anaerobic water (boiled DI H$_2$O for 15 minutes then cooled to room temperature in a water bath while sparging with N$_2$. All media was adjusted to a pH of 6.8 with 2M HCl. 10 mL of media was then aliquoted into 15 mL hungate tubs, and the tubes were then sparged with 80% N$_2$ 20% CO$_2$ for 3 minutes.

TABLE 19

RAMM Salts Media Recipe

| Component | g/500 mL |
|---|---|
| KH$_2$PO$_4$ | 0.11 |
| K$_2$HPO$_4$ | 0.08 |
| NH$_4$Cl | 0.265 |
| NaHCO$_3$ | 0.6 |
| DI H$_2$O | 500 mL |

After sterilization (autoclave) added: 2 mL of 250× modified Wolfe's vitamin mix, 10 mL of 50× modified Wolfe's mineral mix, 5 mL of 100 mM cysteine.

Example VIII. Determination of Maximal Information Coefficient (MIC) Scores for Microbe Strains Relevant to Pounds of Milk Produced Experimental Design and Materials and Methods
Objective:
Determine rumen microbial community constituents that impact the production of milk fat in dairy cows.
Animals:
Eight lactating, ruminally cannulated, Holstein cows were housed in individual tie-stalls for use in the experiment. Cows were fed twice daily, milked twice a day, and had continuous access to fresh water. One cow (cow 1) was removed from the study after the first dietary Milk Fat Depression due to complications arising from an abortion prior to the experiment.

Experimental Design and Treatment:
The experiment used a crossover design with 2 groups and 1 experimental period. The experimental period lasted 38 days: 10 days for the covariate/wash-out period and 28 days for data collection and sampling. The data collection period consisted of 10 days of dietary Milk Fat Depression (MFD) and 18 days of recovery. After the first experimental period, all cows underwent a 10-day wash out period prior to the beginning of period 2.

Dietary MFD was induced with a total mixed ration (TMR) low in fiber (29% NDF) with high starch degradability (70% degradable) and high polyunsaturated fatty acid levels (PUFA, 3.7%). The Recovery phase included two diets variable in starch degradability. Four cows were randomly assigned to the recovery diet high in fiber (37% NDF), low in PUFA (2.6%), and high in starch degradability (70% degradable). The remaining four cows were fed a recovery diet high in fiber (37% NDF), low in PUFA (2.6%), but low in starch degradability (35%).

During the 10-day covariate and 10-day wash out periods, cows were fed the high fiber, low PUFA, and low starch degradability diet.

Samples and Measurements:
Milk yield, dry matter intake, and feed efficiency were measured daily for each animal throughout the covariate, wash out, and sample collection periods. TMR samples were measured for nutrient composition. During the collection period, milk samples were collected and analyzed every 3 days. Samples were analyzed for milk component concentrations (milk fat, milk protein, lactose, milk urea nitrogen, somatic cell counts, and solids) and fatty acid compositions.

Rumen samples were collected and analyzed for microbial community composition and activity every 3 days during the collection period. The rumen was intensively sampled 0, 2, 4, 6, 8, 10, 12, 14, 16, 18, 20, and 22 hours after feeding during day 0, day 7, and day 10 of the dietary MFD. Similarly, the rumen was intensively sampled 0, 2, 4, 6, 8, 10, 12, 14, 16, 18, 20, and 22 hours after feeding on day 16 and day 28 during the recovery period. Rumen contents were analyzed for pH, acetate concentration, butyrate concentration, propionate concentration, isoacid concentration, and long chain and CLA isomer concentrations.

Rumen Sample Preparation and Sequencing:
After collection, rumen samples were centrifuged at 4,000 rpm in a swing bucket centrifuge for 20 minutes at 4° C. The supernatant was decanted, and an aliquot of each rumen content sample (1-2 mg) was added to a sterile 1.7 mL tube prefilled with 0.1 mm glass beads. A second aliquot was collected and stored in an empty, sterile 1.7 mL tube for cell counting.

Rumen samples with glass beads (1$^{st}$ aliquot) were homogenized with bead beating to lyse microorganisms. DNA and RNA was extracted and purified from each sample and prepared for sequencing on an Illumina Miseq. Samples were sequenced using paired-end chemistry, with 300 base pairs sequenced on each end of the library. Rumen samples in empty tubes (2$^{nd}$ aliquot) were stained and put through a flow cytometer to quantify the number of cells of each microorganism type in each sample.

Sequencing Read Processing and Data Analysis:

Sequencing reads were quality trimmed and processed to identify bacterial species present in the rumen based on a marker gene. Count datasets and activity datasets were integrated with the sequencing reads to determine the absolute cell numbers of active microbial species within the rumen microbial community. Production characteristics of the cow over time, including pounds of milk produced, were linked to the distribution of active microorganisms within each sample over the course of the experiment using mutual information. Maximal information coefficient (MIC) scores were calculated between pounds of milk fat produced and the absolute cell count of each active microorganism. Microorganisms were ranked by MIC score, and microorganisms with the highest MIC scores were selected as the target species most relevant to pounds of milk produced.

Tests cases to determine the impact of count data, activity data, and count and activity on the final output were run by omitting the appropriate datasets from the sequencing analysis. To assess the impact of using a linear correlation rather than the MIC on target selection, Pearson's coefficients were also calculated for pounds of milk fat produced as compared to the relative abundance of all microorganisms and the absolute cell count of active microorganisms.

Results and Discussion

Relative Abundances Vs. Absolute Cell Counts

The top 15 target species were identified for the dataset that included cell count data (absolute cell count, Table 21) and for the dataset that did not include cell count data (relative abundance, Table 20) based on MIC scores. Activity data was not used in this analysis in order to isolate the effect of cell count data on final target selection. Ultimately, the top 8 targets were the same between the two datasets. Of the remaining 7, 5 strains were present on both lists in varying order. Despite the differences in rank for these 5 strains, the calculated MIC score for each strain was the identical between the two lists. The two strains present on the absolute cell count list but not the relative abundance list, ascus_111 and ascus_288, were rank 91 and rank 16, respectively, on the relative abundance list. The two strains present on the relative abundance list but not the absolute cell count list, ascus_102 and ascus_252, were rank 50 and rank 19, respectively, on the absolute cell count list. These 4 strains did have different MIC scores on each list, thus explaining their shift in rank and subsequent impact on the other strains in the list.

TABLE 20

Top 15 Target Strains using Relative Abundance with no Activity Filter

| Target Strain | MIC | Nearest Taxonomy |
|---|---|---|
| ascus_7 | 0.97384 | d: Bacteria(1.0000), p: Firmicutes(0.9922), c: Clostridia(0.8756), o: Clostridiales(0.5860), f: Ruminococcaceae(0.3217), g: *Ruminococcus*(0.0605) |
| ascus_82 | 0.97173 | d: Bacteria(1.0000), p: Firmicutes(0.8349), c: Clostridia(0.5251), o: Clostridiales(0.2714), f: Ruminococcaceae(0.1062), g: *Saccharofermentans*(0.0073) |
| ascus_209 | 0.95251 | d: Bacteria(1.0000), p: TM7(0.9991), g: TM7_genera_incertae_sedis(0.8645) |
| ascus_126 | 0.91477 | d: Bacteria(1.0000), p: Firmicutes(0.8349), c: Clostridia(0.5251), o: Clostridiales(0.2714), f: Ruminococcaceae(0.1242), g: *Saccharofermentans*(0.0073) |
| ascus_1366 | 0.89713 | d: Bacteria(1.0000), p: TM7(0.9445), g: TM7_genera_incertae_sedis(0.0986) |
| ascus_1780 | 0.89466 | d: Bacteria(0.9401), p: Bacteroidetes(0.4304), c: Bacteroidia(0.0551), o: Bacteroidales(0.0198), f: Prevotellaceae(0.0067), g: *Prevotella*(0.0052) |
| ascus_64 | 0.89453 | d: Bacteria(1.0000), p: Firmicutes(0.9922), c: Clostridia(0.8823), o: Clostridiales(0.6267), f: Ruminococcaceae(0.2792), g: *Ruminococcus*(0.0605) |
| ascus_299 | 0.88979 | d: Bacteria(1.0000), p: TM7(0.9963), g: TM7_genera_incertae_sedis(0.5795) |
| ascus_102 | 0.87095 | d: Bacteria(1.0000), p: Firmicutes(0.9628), c: Clostridia(0.8317), o: Clostridiales(0.4636), f: Ruminococcaceae(0.2367), g: *Saccharofermentans*(0.0283) |
| ascus_1801 | 0.87038 | d: Bacteria(0.8663), p: Bacteroidetes(0.2483), c: Bacteroidia(0.0365), o: Bacteroidales(0.0179), f: Porphyromonadaceae(0.0059), g: *Butyricimonas*(0.0047) |
| ascus_295 | 0.86724 | d: Bacteria(1.0000), p: SR1(0.9990), g: SR1_genera_incertae_sedis(0.9793) |
| ascus_1139 | 0.8598 | d: Bacteria(1.0000), p: TM7(0.9951), g: TM7_genera_incertae_sedis(0.4747) |
| ascus_127 | 0.84082 | d: Bacteria(1.0000), p: TM7(0.9992), g: TM7_genera_incertae_sedis(0.8035) |
| ascus_341 | 0.8348 | d: Bacteria(1.0000), p: TM7(0.9992), g: TM7_genera_incertae_sedis(0.8035) |
| ascus_252 | 0.82891 | d: Bacteria(1.0000), p: Firmicutes(0.9986), c: Clostridia(0.9022), o: Clostridiales(0.7491), f: Lachnospiraceae(0.3642), g: Lachnospiracea_incertae_sedis(0.0859) |

TABLE 21

Top 15 Target Strains using Absolute cell count with no Activity Filter

| Target Strain | MIC | Nearest Taxonomy |
|---|---|---|
| ascus_7 | 0.97384 | d: Bacteria(1.0000), p: Firmicutes(0.9922), c: Clostridia(0.8756), o: Clostridiales(0.5860), f: Ruminococcaceae(0.3217), g: *Ruminococcus*(0.0605) |
| ascus_82 | 0.97173 | d: Bacteria(1.0000), p: Firmicutes(0.8349), c: Clostridia(0.5251), o: Clostridiales(0.2714), f: Ruminococcaceae(0.1062), g: *Saccharofermentans*(0.0073) |
| ascus_209 | 0.95251 | d: Bacteria(1.0000), p: TM7(0.9991), g: TM7_genera_incertae_sedis(0.8645) |
| ascus_126 | 0.91701 | d: Bacteria(1.0000), p: Firmicutes(0.8349), c: Clostridia(0.5251), o: Clostridiales(0.2714), f: Ruminococcaceae(0.1242), g: *Saccharofermentans*(0.0073) |
| ascus_1366 | 0.89713 | d: Bacteria(1.0000), p: TM7(0.9445), g: TM7_genera_incertae_sedis(0.0986) |
| ascus_1780 | 0.89466 | d: Bacteria(0.9401), p: Bacteroidetes(0.4304), c: Bacteroidia(0.0551), o: Bacteroidales(0.0198), f: Prevotellaceae(0.0067), g: *Prevotella*(0.0052) |
| ascus_64 | 0.89453 | d: Bacteria(1.0000), p: Firmicutes(0.9922), c: Clostridia(0.8823), o: Clostridiales(0.6267), f: Ruminococcaceae(0.2792), g: *Ruminococcus*(0.0605) |
| ascus_299 | 0.88979 | d: Bacteria(1.0000), p: TM7(0.9963), g: TM7_genera_incertae_sedis(0.5795) |
| ascus_1801 | 0.87038 | d: Bacteria(0.8663), p: Bacteroidetes(0.2483), c: Bacteroidia(0.0365), o: Bacteroidales(0.0179), f: Porphyromonadaceae(0.0059), g: *Butyricimonas*(0.0047) |
| ascus_295 | 0.86724 | d: Bacteria(1.0000), p: SR1(0.9990), g: SR1_genera_incertae_sedis(0.9793) |
| ascus_1139 | 0.8598 | d: Bacteria(1.0000), p: TM7(0.9951), g: TM7_genera_incertae_sedis(0.4747) |
| ascus_127 | 0.84082 | d: Bacteria(1.0000), p: TM7(0.9992), g: TM7_genera_incertae_sedis(0.8035) |
| ascus_341 | 0.8348 | d: Bacteria(1.0000), p: TM7(0.9992), g: TM7_genera_incertae_sedis(0.8035) |
| ascus_111 | 0.83358 | d: Bacteria(1.0000), p: Firmicutes(0.7947), c: Clostridia(0.4637), o: Clostridiales(0.2335), f: Ruminococcaceae(0.1062), g: *Papillibacter*(0.0098) |
| ascus_288 | 0.82833 | d: Bacteria(0.7925), p: Bacteroidetes(0.2030), c: Bacteroidia(0.0327), o: Bacteroidales(0.0160), f: Porphyromonadaceae(0.0050), g: *Butyricimonas*(0.0042) |

Integration of cell count data did not always affect the final MIC score assigned to each strain. This may be attributed to the fact that although the microbial population did shift within the rumen daily and over the course of the 38-day experiment, it was always within $10^7$-$10^8$ cells per milliliter. Much larger shifts in population numbers would undoubtedly have a broader impact on final MIC scores.

Inactive Species Vs. Active Species

In order to assess the impact of filtering strains based on activity data, target species were identified from a dataset that leveraged relative abundance with (Table 22) and without (Table 20) activity data as well as a dataset that leveraged absolute cell counts with (Table 23) and without (Table 21) activity data.

For the relative abundance case, ascus_126, ascus_1366, ascus_1780, ascus_299, ascus_1139, ascus_127, ascus_341, and ascus_252 were deemed target strains prior to applying activity data. These eight strains (53% of the initial top 15 targets) fell below rank 15 after integrating activity data. A similar trend was observed for the absolute cell count case. Ascus_126, ascus_1366, ascus_1780, ascus_299, ascus_1139, ascus_127, and ascus_341 (46% of the initial top 15 targets) fell below rank 15 after activity dataset integration.

The activity datasets had a much more severe effect on target rank and selection than the cell count datasets. When integrating these datasets together, if a sample is found to be inactive it is essentially changed to a "0" and not considered to be part of the analysis. Because of this, the distribution of points within a sample can become heavily altered or skewed after integration, which in turn greatly impacts the final MIC score and thus the rank order of target microorganisms.

TABLE 22

Top 15 Target Strains using Relative Abundance with Activity Filter

| Target Strain | MIC | Nearest Taxonomy |
|---|---|---|
| ascus_7 | 0.97384 | d: Bacteria(1.0000), p: Firmicutes(0.9922), c: Clostridia(0.8756), o: Clostridiales(0.5860), f: Ruminococcaceae(0.3217), g: *Ruminococcus*(0.0605) |
| ascus_82 | 0.93391 | d: Bacteria(1.0000), p: Firmicutes(0.8349), c: Clostridia(0.5251), o: Clostridiales(0.2714), f: Ruminococcaceae(0.1062), g: *Saccharofermentans*(0.0073) |
| ascus_102 | 0.87095 | d: Bacteria(1.0000), p: Firmicutes(0.9628), c: Clostridia(0.8317), o: Clostridiales(0.4636), f: Ruminococcaceae(0.2367), g: *Saccharofermentans*(0.0283) |
| ascus_209 | 0.84421 | d: Bacteria(1.0000), p: TM7(0.9991), g: TM7_genera_incertae_sedis(0.8645) |
| ascus_1801 | 0.82398 | d: Bacteria(0.8663), p: Bacteroidetes(0.2483), c: Bacteroidia(0.0365), o: Bacteroidales(0.0179), f: Porphyromonadaceae(0.0059), g: *Butyricimonas*(0.0047) |
| ascus_372 | 0.81735 | d: Bacteria(1.0000), p: Spirochaetes(0.9445), c: Spirochaetes(0.8623), o: Spirochaetales(0.5044), f: Spirochaetaceae(0.3217), g: *Spirochaeta*(0.0190) |

TABLE 22-continued

Top 15 Target Strains using Relative Abundance with Activity Filter

| Target Strain | MIC | Nearest Taxonomy |
|---|---|---|
| ascus_26 | 0.81081 | d: Bacteria(1.0000), p: Firmicutes(0.9080), c: Clostridia(0.7704), o: Clostridiales(0.4230), f: Ruminococcaceae(0.1942), g: Clostridium_IV(0.0144) |
| ascus_180 | 0.80702 | d: Bacteria(1.0000), p: Spirochaetes(0.9445), c: Spirochaetes(0.8623), o: Spirochaetales(0.5044), f: Spirochaetaceae(0.3217), g: *Spirochaeta*(0.0237) |
| ascus_32 | 0.7846 | d: Bacteria(1.0000), p: Firmicutes(0.7036), c: Clostridia(0.4024), o: Clostridiales(0.1956), f: Ruminococcaceae(0.0883), g: *Hydrogenoanaerobacterium*(0.0144) |
| ascus_288 | 0.78229 | d: Bacteria(0.7925), p: Bacteroidetes(0.2030), c: Bacteroidia(0.0327), o: Bacteroidales(0.0160), f: Porphyromonadaceae(0.0050), g: *Butyricimonas*(0.0042) |
| ascus_64 | 0.77514 | d: Bacteria(1.0000), p: Firmicutes(0.9922), c: Clostridia(0.8823), o: Clostridiales(0.6267), f: Ruminococcaceae(0.2792), g: *Ruminococcus*(0.0605) |
| ascus_295 | 0.76639 | d: Bacteria(1.0000), p: SR1(0.9990), g: SR1_genera_incertae_sedis(0.9793) |
| ascus_546 | 0.76114 | d: Bacteria(1.0000), p: Firmicutes(0.6126), c: Clostridia(0.2851), o: Clostridiales(0.1324), f: Clostridiaceae_1(0.0208), g: Clostridium_sensu_stricto(0.0066) |
| ascus_233 | 0.75779 | d: Bacteria(1.0000), p: Firmicutes(0.9922), c: Clostridia(0.8756), o: Clostridiales(0.5860), f: Ruminococcaceae(0.3642), g: *Ruminococcus*(0.0478) |
| ascus_651 | 0.74837 | d: Bacteria(1.0000), p: Firmicutes(0.7947), c: Clostridia(0.4637), o: Clostridiales(0.2335), f: Ruminococcaceae(0.0883), g: Clostridium_IV(0.0069) |

TABLE 23

Top 15 Target Strains using Absolute cell count with Activity Filter

| Target Strain | MIC | Nearest Taxonomy |
|---|---|---|
| ascus_7 | 0.97384 | d: Bacteria(1.0000), p: Firmicutes(0.9922), c: Clostridia(0.8756), o: Clostridiales(0.5860), f: Ruminococcaceae(0.3217), g: *Ruminococcus*(0.0605) |
| ascus_82 | 0.93391 | d: Bacteria(1.0000), p: Firmicutes(0.8349), c: Clostridia(0.5251), o: Clostridiales(0.2714), f: Ruminococcaceae(0.1062), g: *Saccharofermentans*(0.0073) |
| ascus_209 | 0.84421 | d: Bacteria(1.0000), p: TM7(0.9991), g: TM7_genera_incertae_sedis(0.8645) |
| ascus_1801 | 0.82398 | d: Bacteria(0.8663), p: Bacteroidetes(0.2483), c: Bacteroidia(0.0365), o: Bacteroidales(0.0179), f: Porphyromonadaceae(0.0059), g: *Butyricimonas*(0.0047) |
| ascus_372 | 0.81735 | d: Bacteria(1.0000), p: Spirochaetes(0.9445), c: Spirochaetes(0.8623), o: Spirochaetales(0.5044), f: Spirochaetaceae(0.3217), g: *Spirochaeta*(0.0190) |
| ascus_26 | 0.81081 | d: Bacteria(1.0000), p: Firmicutes(0.9080), c: Clostridia(0.7704), o: Clostridiales(0.4230), f: Ruminococcaceae(0.1942), g: Clostridium_IV(0.0144) |
| ascus_102 | 0.81048 | d: Bacteria(1.0000), p: Firmicutes(0.9628), c: Clostridia(0.8317), o: Clostridiales(0.4636), f: Ruminococcaceae(0.2367), g: *Saccharofermentans*(0.0283) |
| ascus_111 | 0.79035 | d: Bacteria(1.0000), p: Firmicutes(0.7947), c: Clostridia(0.4637), o: Clostridiales(0.2335), f: Ruminococcaceae(0.1062), g: *Papillibacter*(0.0098) |
| ascus_288 | 0.78229 | d: Bacteria(0.7925), p: Bacteroidetes(0.2030), c: Bacteroidia(0.0327), o: Bacteroidales(0.0160), f: Porphyromonadaceae(0.0050), g: *Butyricimonas*(0.0042) |
| ascus_64 | 0.77514 | d: Bacteria(1.0000), p: Firmicutes(0.9922), c: Clostridia(0.8823), o: Clostridiales(0.6267), f: Ruminococcaceae(0.2792), g: *Ruminococcus*(0.0605) |
| ascus_295 | 0.76639 | d: Bacteria(1.0000), p: SR1(0.9990), g: SR1_genera_incertae_sedis(0.9793) |
| ascus_546 | 0.76114 | d: Bacteria(1.0000), p: Firmicutes(0.6126), c: Clostridia(0.2851), o: Clostridiales(0.1324), f: Clostridiaceae_1(0.0208), g: Clostridium_sensu_stricto(0.0066) |
| ascus_32 | 0.75068 | d: Bacteria(1.0000), p: Firmicutes(0.7036), c: Clostridia(0.4024), o: Clostridiales(0.1956), f: Ruminococcaceae(0.0883), g: *Hydrogenoanaerobacterium*(0.0144) |
| ascus_651 | 0.74837 | d: Bacteria(1.0000), p: Firmicutes(0.7947), c: Clostridia(0.4637), o: Clostridiales(0.2335), f: Ruminococcaceae(0.0883), g: Clostridium_IV(0.0069) |
| ascus_233 | 0.74409 | d: Bacteria(1.0000), p: Firmicutes(0.9922), c: Clostridia(0.8756), o: Clostridiales(0.5860), f: Ruminococcaceae(0.3642), g: *Ruminococcus*(0.0478) |

Relative Abundances and Inactive Vs. Absolute Cell Counts and Active

Ultimately, the method defined here leverages both cell count data and activity data to identify microorganisms highly linked to relevant metadata characteristics. Within the top 15 targets selected using both methods (Table 23, Table 20), only 7 strains were found on both lists. Eight strains (53%) were unique to the absolute cell count and activity list. The top 3 targets on both lists matched in both strain as well as in rank. However, two of the three did not have the same MIC score on both lists, suggesting that they were influenced by activity dataset integration but not enough to upset their rank order.

Linear Correlations Vs. Nonparametric Approaches

Pearson's coefficients and MIC scores were calculated between pounds of milk fat produced and the absolute cell count of active microorganisms within each sample (Table 24). Strains were ranked either by MIC (Table 24a) or Pearson coefficient (Table 24b) to select target strains most relevant to milk fat production. Both MIC score and Pearson coefficient are reported in each case. Six strains were found on both lists, meaning nine (60%) unique strains were identified using the MIC approach. The rank order of strains between lists did not match—the top 3 target strains identified by each method were also unique.

Figure 18:
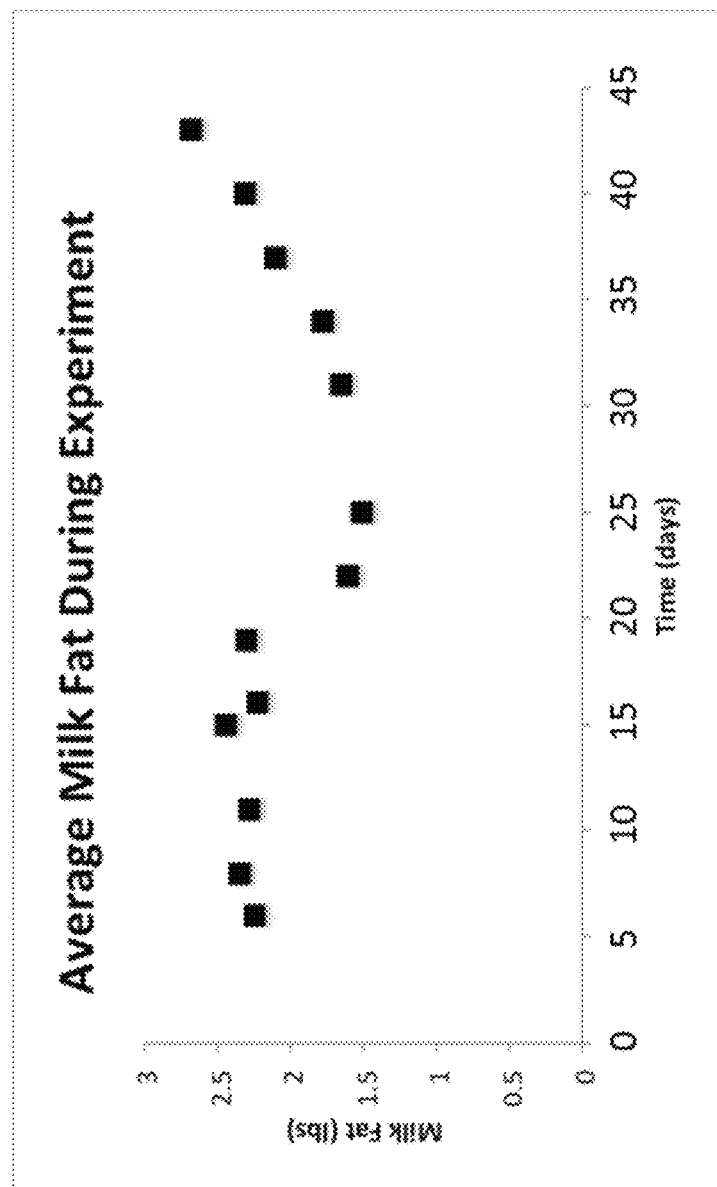
FIG. 18 depicts the non-linearity of pounds of milk fate produced over the course of an experiment to determine rumen microbial community constituents that impact the production of milk fat in dairy cows.
Figure 19:
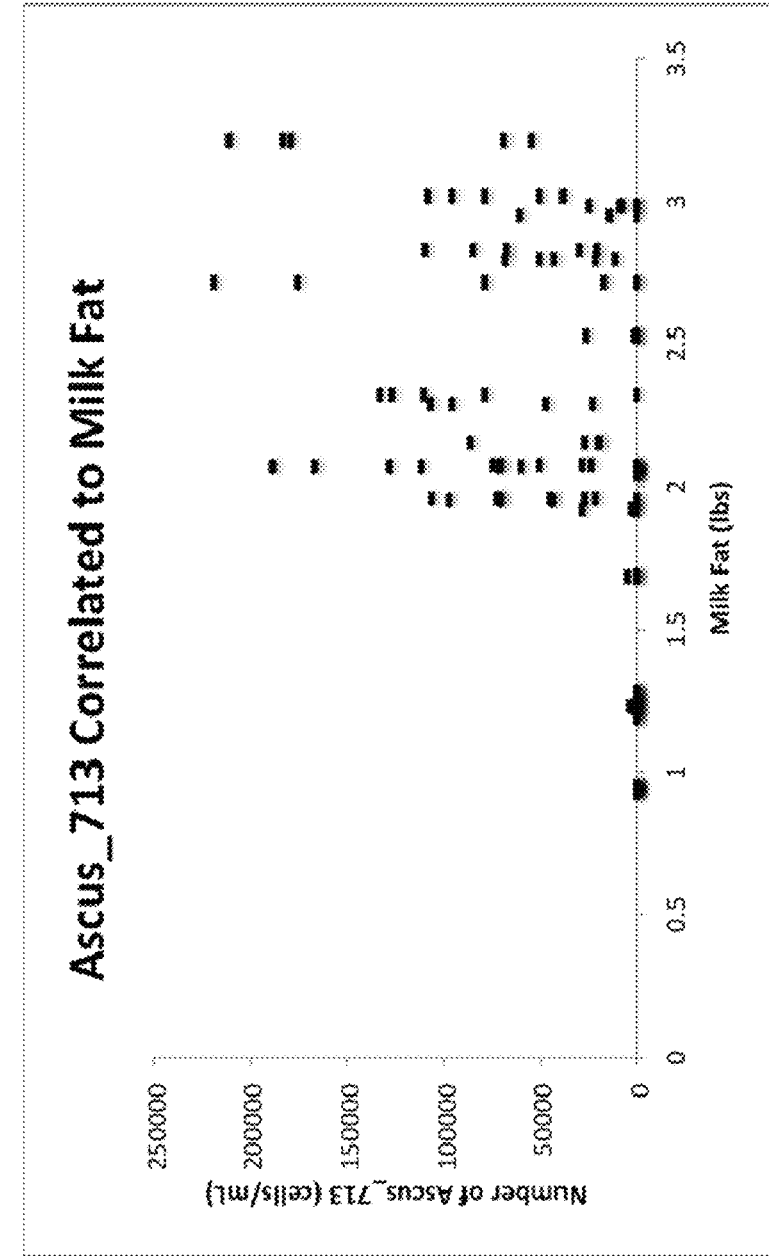
FIG. 19 depicts the correlation of the absolute cell count with activity filter of target strain Ascus_713 to pounds (lbs) of milk fat produced.
Figure 20:
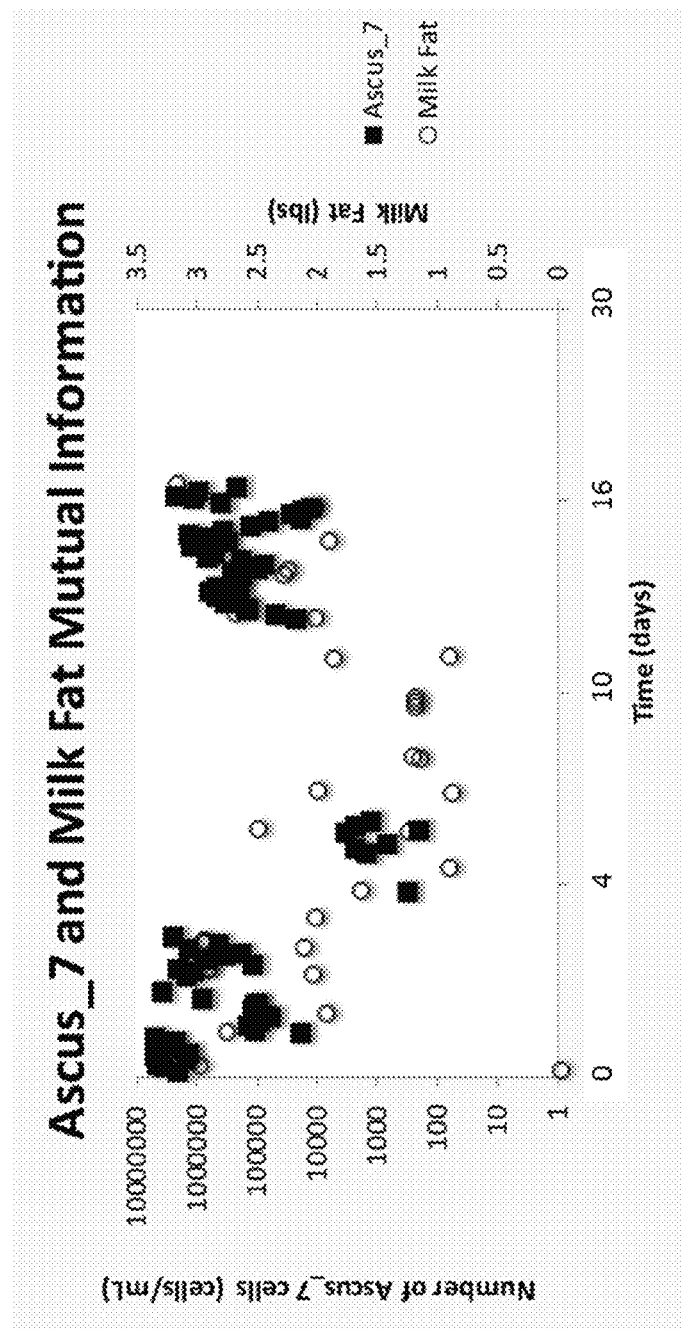
FIG. 20 depicts the absolute cell count with activity filter of target strain Ascus_7 and the pounds (lbs) of milk fat produced over the course of an experiment.

Like Pearson coefficients, the MIC score is reported over a range of 0 to 1, with 1 suggesting a very tight relationship between the two variables. Here, the top 15 targets exhibited MIC scores ranging from 0.97 to 0.74. The Pearson coefficients for the correlation test case, however, ranged from 0.53 to 0.45—substantially lower than the mutual information test case. This discrepancy may be due to the differences inherent to each analysis method. While correlations are a linear estimate that measures the dispersion of points around a line, mutual information leverages probability distributions and measures the similarity between two distributions. Over the course of the experiment, the pounds of milk fat produced changed nonlinearly (FIG. 18). This particular function may be better represented and approximated by mutual information than correlations. To investigate this, the top target strains identified using correlation and mutual information, Ascus_713 (FIG. 19) and Ascus_7 (FIG. 20) respectively, were plotted to determine how well each method predicted relationships between the strains and milk fat. If two variables exhibit strong correlation, they are represented by a line with little to no dispersion of points when plotted against each other. In FIG. 19, Ascus_713 correlates weakly with milk fat, as indicated by the broad spread of points. Mutual information, again, measures how similar two distributions of points are. When Ascus_7 is plotted with milk fat (FIG. 20), it is apparent that the two point distributions are very similar.

The Present Method in Entirety Vs. Conventional Approaches

Figure 21:
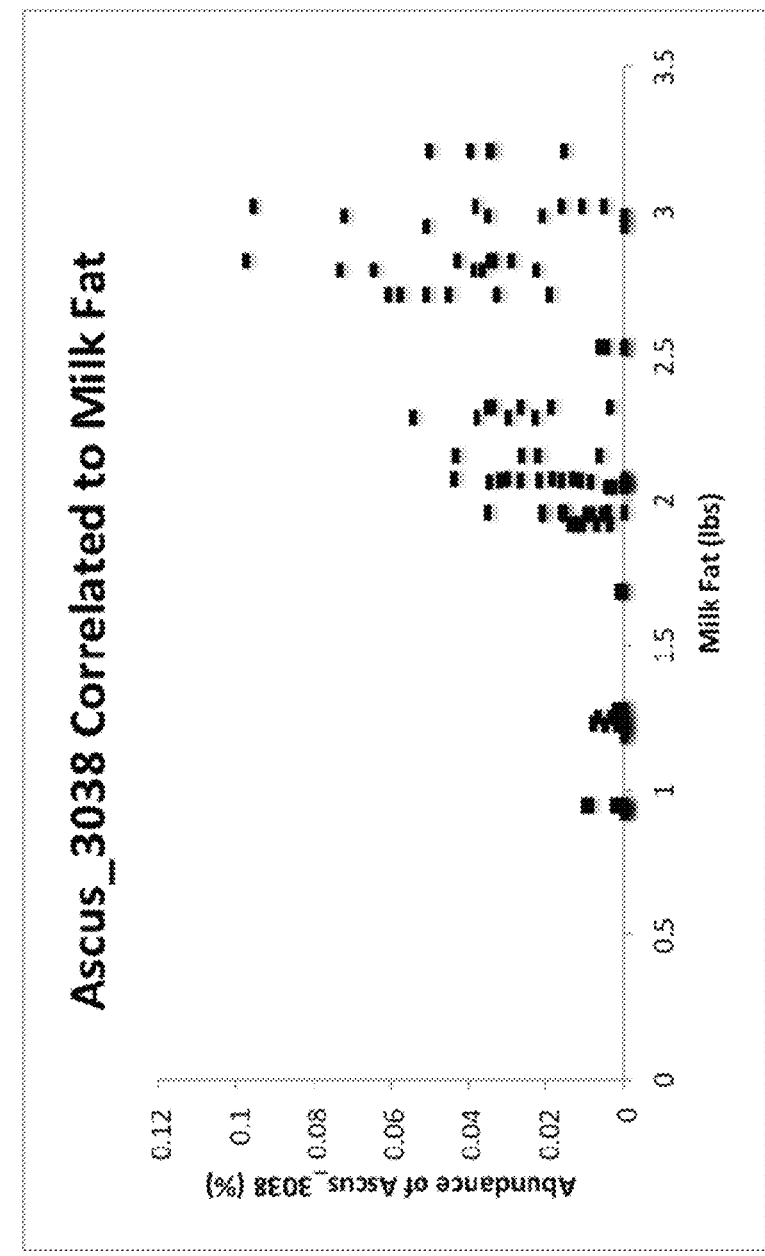
FIG. 21 depicts the correlation of the relative abundance with no activity filter of target strain Ascus_3038 to pounds (lbs) of milk fat produced.

The conventional approach of analyzing microbial communities relies on the use of relative abundance data with no incorporation of activity information, and ultimately ends with a simple correlation of microbial species to metadata (see, e.g., U.S. Pat. No. 9,206,680, which is herein incorporated by reference in its entirety for all purposes). Here, we have shown how the incorporation of each dataset incrementally influences the final list of targets. When applied in its entirety, the method described herein selected a completely different set of targets when compared to the conventional method (Table 24a and Table 24c). Ascus_3038, the top target strain selected using the conventional approach, was plotted against milk fat to visualize the strength of the correlation (FIG. 21). Like the previous example, Ascus_3038 also exhibited a weak correlation to milk fat.

Table 24: Top 15 Target Strains using Mutual Information or Correlations

TABLE 24a

| | | | |
|---|---|---|---|
| MIC using Absolute cell count with Activity Filter | | | |
| Target Strain | MIC | Pearson Coefficient | Nearest Taxonomy |
| ascus_7 | 0.97384 | 0.25282502 | d: Bacteria(1.0000), p: Firmicutes(0.9922), c: Clostridia(0.8756), o: Clostridiales(0.5860), f: Ruminococcaceae(0.3217), g: *Ruminococcus*(0.0605) |
| ascus_82 | 0.93391 | 0.42776647 | d: Bacteria(1.0000), p: Firmicutes(0.8349), c: Clostridia(0.5251), o: Clostridiales(0.2714), f: Ruminococcaceae(0.1062), g: *Saccharofermentans*(0.0073) |
| ascus_209 | 0.84421 | 0.3036308 | d: Bacteria(1.0000), p: TM7(0.9991), g: TM7_genera_incertae_sedis(0.8645) |
| ascus_1801 | 0.82398 | 0.5182261 | d: Bacteria(0.8663), p: Bacteroidetes(0.2483), c: Bacteroidia(0.0365), o: Bacteroidales(0.0179), f: Porphyromonadaceae(0.0059), g: *Butyricimonas*(0.0047) |
| ascus_372 | 0.81735 | 0.34172258 | d: Bacteria(1.0000), p: Spirochaetes(0.9445), c: Spirochaetes(0.8623), o: Spirochaetales(0.5044), f: Spirochaetaceae(0.3217), g: *Spirochaeta*(0.0190) |
| ascus_26 | 0.81081 | 0.5300298 | d: Bacteria(1.0000), p: Firmicutes(0.9080), c: Clostridia(0.7704), o: Clostridiales(0.4230), f: Ruminococcaceae(0.1942), g: Clostridium_IV(0.0144) |
| ascus_102 | 0.81048 | 0.35456932 | d: Bacteria(1.0000), p: Firmicutes(0.9628), c: Clostridia(0.8317), o: Clostridiales(0.4636), f: Ruminococcaceae(0.2367), g: *Saccharofermentans*(0.0283) |
| ascus_111 | 0.79035 | 0.45881805 | d: Bacteria(1.0000), p: Firmicutes(0.7947), c: Clostridia(0.4637), o: Clostridiales(0.2335), f: Ruminococcaceae(0.1062), g: *Papillibacter*(0.0098) |
| ascus_288 | 0.78229 | 0.46522045 | d: Bacteria(0.7925), p: Bacteroidetes(0.2030), c: Bacteroidia(0.0327), o: Bacteroidales(0.0160), f: Porphyromonadaceae(0.0050), g: *Butyricimonas*(0.0042) |
| ascus_64 | 0.77514 | 0.45417055 | d: Bacteria(1.0000), p: Firmicutes(0.9922), c: Clostridia(0.8823), o: Clostridiales(0.6267), f: Ruminococcaceae(0.2792), g: *Ruminococcus*(0.0605) |
| ascus_295 | 0.76639 | 0.24972263 | d: Bacteria(1.0000), p: SR1(0.9990), g: SR1_genera_incertae_sedis(0.9793) |
| ascus_546 | 0.76114 | 0.23819838 | d: Bacteria(1.0000), p: Firmicutes(0.6126), c: Clostridia(0.2851), o: Clostridiales(0.1324), f: Clostridiaceae_1(0.0208), g: Clostridium_sensu_stricto(0.0066) |
| ascus_32 | 0.75068 | 0.5179697 | d: Bacteria(1.0000), p: Firmicutes(0.7036), c: Clostridia(0.4024), o: Clostridiales(0.1956), f: Ruminococcaceae(0.0883), g: *Hydrogenoanaerobacterium*(0.0144) |
| ascus_651 | 0.74837 | 0.27656645 | d: Bacteria(1.0000), p: Firmicutes(0.7947), c: Clostridia(0.4637), o: Clostridiales(0.2335), f: Ruminococcaceae(0.0883), g: Clostridium_IV(0.0069) |

TABLE 24a-continued

MIC using Absolute cell count with Activity Filter

| Target Strain | MIC | Pearson Coefficient | Nearest Taxonomy |
|---|---|---|---|
| ascus_233 | 0.74409 | 0.36095098 | d: Bacteria(1.0000), p: Firmicutes(0.9922), c: Clostridia(0.8756), o: Clostridiales(0.5860), f: Ruminococcaceae(0.3642), g: *Ruminococcus*(0.0478) |

TABLE 24b

Correlation using Absolute cell count with Activity Filter

| Target Strain | MIC | Pearson Coefficient | Nearest Taxonomy |
|---|---|---|---|
| ascus_713 | 0.71066 | 0.5305876 | d: Bacteria(1.0000), p: Firmicutes(0.8349), c: Clostridia(0.5251), o: Clostridiales(0.2714), f: Ruminococcaceae(0.1062), g: *Saccharofermentans*(0.0073) |
| ascus_26 | 0.81081 | 0.5300298 | d: Bacteria(1.0000), p: Firmicutes(0.9080), c: Clostridia(0.7704), o: Clostridiales(0.4230), f: Ruminococcaceae(0.1942), g: Clostridium_IV(0.0144) |
| ascus_1801 | 0.82398 | 0.5182261 | d: Bacteria(0.8663), p: Bacteroidetes(0.2483), c: Bacteroidia(0.0365), o: Bacteroidales(0.0179), f: Porphyromonadaceae(0.0059), g: *Butyricimonas*(0.0047) |
| ascus_32 | 0.75068 | 0.5179697 | d: Bacteria(1.0000), p: Firmicutes(0.7036), c: Clostridia(0.4024), o: Clostridiales(0.1956), f: Ruminococcaceae(0.0883), g: *Hydrogenoanaerobacterium*(0.0144) |
| ascus_119 | 0.6974 | 0.4968678 | d: Bacteria(1.0000), p: Firmicutes(0.9922), c: Clostridia(0.8756), o: Clostridiales(0.5860), f: Ruminococcaceae(0.3217), g: *Ruminococcus*(0.0478) |
| ascus_13899 | 0.64556 | 0.48739454 | d: Bacteria(1.0000), p: Actinobacteria(0.1810), c: Actinobacteria(0.0365), o: Actinomycetales(0.0179), f: Propionibacteriaceae(0.0075), g: *Microlunatus*(0.0058) |
| ascus_906 | 0.49256 | 0.48418677 | d: Bacteria(1.0000), p: Firmicutes(0.8349), c: Clostridia(0.5251), o: Clostridiales(0.2714), f: Ruminococcaceae(0.1242), g: *Papillibacter*(0.0098) |
| ascus_221 | 0.44006 | 0.47305903 | d: Bacteria(1.0000), p: Bacteroidetes(0.9991), c: Bacteroidia(0.9088), o: Bacteroidales(0.7898), f: Prevotellaceae(0.3217), g: *Prevotella*(0.0986) |
| ascus_1039 | 0.65629 | 0.46932846 | d: Bacteria(1.0000), p: Firmicutes(0.7036), c: Clostridia(0.2851), o: Clostridiales(0.1324), f: Ruminococcaceae(0.0329), g: Clostridium_IV(0.0069) |
| ascus_288 | 0.78229 | 0.46522045 | d: Bacteria(0.7925), p: Bacteroidetes(0.2030), c: Bacteroidia(0.0327), o: Bacteroidales(0.0160), f: Porphyromonadaceae(0.0050), g: *Butyricimonas*(0.0042) |
| ascus_589 | 0.40868 | 0.4651165 | d: Bacteria(1.0000), p: Firmicutes(0.9981), c: Clostridia(0.9088), o: Clostridiales(0.7898), f: Lachnospiraceae(0.5986), g: Clostridium_XIVa(0.3698) |
| ascus_41 | 0.67227 | 0.46499047 | d: Bacteria(1.0000), p: Firmicutes(0.6126), c: Clostridia(0.3426), o: Clostridiales(0.1618), f: Ruminococcaceae(0.0703), g: *Hydrogenoanaerobacterium*(0.0098) |
| ascus_111 | 0.79035 | 0.45881805 | d: Bacteria(1.0000), p: Firmicutes(0.7947), c: Clostridia(0.4637), o: Clostridiales(0.2335), f: Ruminococcaceae(0.1062), g: *Papillibacter*(0.0098) |
| ascus_205 | 0.72441 | 0.45684373 | d: Bacteria(1.0000), p: Firmicutes(0.6126), c: Clostridia(0.3426), o: Clostridiales(0.1618), f: Peptococcaceae_2(0.0449), g: *Pelotomaculum*(0.0069) |
| ascus_64 | 0.77514 | 0.45417055 | d: Bacteria(1.0000), p: Firmicutes(0.9922), c: Clostridia(0.8823), o: Clostridiales(0.6267), f: Ruminococcaceae(0.2792), g: *Ruminococcus*(0.0605) |

TABLE 24c

Correlation using Relative Abundance with no Activity Filter

| Target Strain | MIC | Pearson Coefficient | Nearest Taxonomy |
|---|---|---|---|
| ascus_3038 | 0.56239 | 0.6007549 | d: Bacteria(1.0000), p: Firmicutes(0.9945), c: Clostridia(0.8623), o: Clostridiales(0.5044), f: Lachnospiraceae(0.2367), g: Clostridium_XIVa(0.0350) |
| ascus_1555 | 0.66965 | 0.59716415 | d: Bacteria(1.0000), p: Firmicutes(0.7947), c: Clostridia(0.3426), o: Clostridiales(0.1618), f: Ruminococcaceae(0.0449), g: Clostridium_IV(0.0073) |
| ascus_1039 | 0.68563 | 0.59292555 | d: Bacteria(1.0000), p: Firmicutes(0.7036), c: Clostridia(0.2851), o: Clostridiales(0.1324), f: Ruminococcaceae(0.0329), g: Clostridium_IV(0.0069) |

TABLE 24c-continued

Correlation using Relative Abundance with no Activity Filter

| Target Strain | MIC | Pearson Coefficient | Nearest Taxonomy |
|---|---|---|---|
| ascus_1424 | 0.55509 | 0.57589555 | d: Bacteria(1.0000), p: Firmicutes(0.8897), c: Clostridia(0.7091), o: Clostridiales(0.3851), f: Ruminococcaceae(0.1422), g: *Papillibacter*(0.0144) |
| ascus_378 | 0.77519 | 0.5671971 | d: Bacteria(1.0000), p: Firmicutes(0.8349), c: Clostridia(0.5251), o: Clostridiales(0.2714), f: Ruminococcaceae(0.1062), g: *Saccharofermentans*(0.0073) |
| ascus_407 | 0.69783 | 0.56279755 | d: Bacteria(1.0000), p: Firmicutes(0.7036), c: Clostridia(0.3426), o: Clostridiales(0.1618), f: Clostridiaceae_1(0.0329), g: Clostridium_sensu_stricto(0.0069) |
| ascus_1584 | 0.5193 | 0.5619939 | d: Bacteria(1.0000), p: Firmicutes(0.9945), c: Clostridia(0.8756), o: Clostridiales(0.5860), f: Lachnospiraceae(0.3217), g: *Coprococcus*(0.0605) |
| ascus_760 | 0.61363 | 0.55807924 | d: Bacteria(1.0000), p: Firmicutes(0.6126), c: Clostridia(0.2851), o: Clostridiales(0.1324), f: Clostridiaceae_1(0.0208), g: Clostridium_sensu_stricto(0.0066) |
| ascus_1184 | 0.70593 | 0.5578006 | d: Bacteria(1.0000), p: "Bacteroidetes"(0.9992), c: "Bacteroidia"(0.8690), o: "Bacteroidales"(0.5452), f: Bacteroidaceae(0.1062), g: *Bacteroides*(0.0237) |
| ascus_7394 | 0.6269 | 0.5557023 | d: Bacteria(1.0000), p: Firmicutes(0.9939), c: Clostridia(0.7704), o: Clostridiales(0.4230), f: Lachnospiraceae(0.1422), g: Clostridium_XIVa(0.0350) |
| ascus_1360 | 0.57343 | 0.5535785 | d: Bacteria(1.0000), p: Firmicutes(0.9992), c: Clostridia(0.9351), o: Clostridiales(0.8605), f: Lachnospiraceae(0.7052), g: Clostridium_XIVa(0.2649) |
| ascus_3175 | 0.53565 | 0.54864305 | d: Bacteria(1.0000), p: "Bacteroidetes"(0.9991), c: "Bacteroidia"(0.8955), o: "Bacteroidales"(0.7083), f: "Prevotellaceae"(0.1942), g: *Prevotella*(0.0605) |
| ascus_2581 | 0.68361 | 0.5454486 | d: Bacteria(1.0000), p: "Spirochaetes"(0.9445), c: Spirochaetes(0.8623), o: Spirochaetales(0.5044), f: Spirochaetaceae(0.3217), g: *Spirochaeta*(0.0237) |
| ascus_531 | 0.71315 | 0.5400517 | d: Bacteria(1.0000), p: Firmicutes(0.6126), c: Clostridia(0.2851), o: Clostridiales(0.1324), f: Clostridiaceae_1(0.0208), g: Clostridium_sensu_stricto(0.0066) |
| ascus_1858 | 0.65165 | 0.5393882 | d: Bacteria(1.0000), p: "Spirochaetes"(0.9263), c: Spirochaetes(0.8317), o: Spirochaetales(0.4636), f: Spirochaetaceae(0.2792), g: *Spirochaeta*(0.0237) |

Numbered Embodiments of the Disclosure

Subject matter contemplated by the present disclosure is set out in the following numbered embodiments:

1. A shelf-stable ruminant supplement capable of increasing milk production or improving milk compositional characteristics in a ruminant, comprising:
   a) a purified population of *Pichia* fungi comprising a fungi with an ITS nucleic acid sequence that is at least about 97% identical to SEQ ID NO: 32; and
   b) a shelf-stable carrier suitable for ruminant administration,
   wherein the purified population of *Pichia* fungi of a) is present in the supplement in an amount effective to increase milk production or improve milk compositional characteristics in a ruminant administered the supplement, as compared to a ruminant not administered the supplement.

2. The shelf-stable ruminant supplement according to claim 1, wherein the purified population of *Pichia* fungi comprises a fungi with an ITS nucleic acid sequence that is at least about 99% identical to SEQ ID NO: 32.

3. The shelf-stable ruminant supplement according to claim 1, wherein the purified population of *Pichia* fungi comprises a fungi with an ITS nucleic acid sequence comprising SEQ ID NO: 32.

4. The shelf-stable ruminant supplement according to claim 1, wherein the purified population of *Pichia* fungi comprises a fungi as deposited at NRRL Y-67249.

5. The shelf-stable ruminant supplement according to claim 1, further comprising:
   i. a purified population of bacteria that comprises a bacteria with a 16S nucleic acid sequence that is at least about 97% identical to a nucleic acid sequence selected from the group consisting of: SEQ ID NOs: 1-30 and 2045-2103, and/or
   ii. a purified population of fungi that comprises a fungi with an ITS nucleic acid sequence that is at least about 97% identical to a nucleic acid sequence selected from the group consisting of: SEQ ID NOs: 31, 33-60 and 2104-2107.

6. The shelf-stable ruminant supplement according to claim 5, wherein the purified population of bacteria comprises a bacteria with a 16S nucleic acid sequence that is at least about 99% identical to a nucleic acid sequence selected from the group consisting of: SEQ ID NOs: 1-30 and 2045-2103.

7. The shelf-stable ruminant supplement according to claim 5, wherein the purified population of fungi comprises a fungi with an ITS nucleic acid sequence that is at least about 99% identical to a nucleic acid sequence selected from the group consisting of: SEQ ID NOs: 31, 33-60 and 2104-2107.

8. The shelf-stable ruminant supplement according to claim 5, wherein the purified population of bacteria comprises a bacteria with a 16S nucleic acid sequence selected from the group consisting of: SEQ ID NOs: 1-30 and 2045-2103.

9. The shelf-stable ruminant supplement according to claim 5, wherein the purified population of fungi comprises a fungi with an ITS nucleic acid sequence selected from the group consisting of: SEQ ID NOs: 31, 33-60 and 2104-2107.

10. The shelf-stable ruminant supplement according to claim 5, wherein the purified population of bacteria comprises a bacteria with a 16S nucleic acid sequence that is at least about 97% identical to SEQ ID NO: 28.

11. The shelf-stable ruminant supplement according to claim 5, wherein the purified population of bacteria comprises a bacteria with a 16S nucleic acid sequence that is at least about 99% identical to SEQ ID NO: 28.
12. The shelf-stable ruminant supplement according to claim 5, wherein the purified population of bacteria comprises a bacteria with a 16S nucleic acid sequence comprising SEQ ID NO: 28.
13. The shelf-stable ruminant supplement according to claim 5, wherein the purified population of bacteria comprises a bacteria as deposited at NRRL B-67248.
14. The shelf-stable ruminant supplement according to claim 5, wherein both a purified population of bacteria i) and a purified population of fungi ii) are present in the supplement.
15. The shelf-stable ruminant supplement according to claim 1, formulated for administration to a cow.
16. The shelf-stable ruminant supplement according to claim 1, wherein the supplement is stable under ambient conditions for at least one week.
17. The shelf-stable ruminant supplement according to claim 1, formulated as an: encapsulation, tablet, capsule, pill, feed additive, food ingredient, food additive, food preparation, food supplement, consumable solution, consumable spray additive, consumable solid, consumable gel, injection, suppository, bolus, drench, or combinations thereof.
18. The shelf-stable ruminant supplement according to claim 1, wherein the purified population of *Pichia* fungi is present in the ruminant supplement at a concentration of at least $10^2$ cells.
19. The shelf-stable ruminant supplement according to claim 1, wherein the ruminant administered the supplement exhibits an increase in milk production that leads to a measured increase in milk yield.
20. The shelf-stable ruminant supplement according to claim 1, wherein the ruminant administered the supplement exhibits an increase in milk production and improved milk compositional characteristics that leads to a measured increase in energy-corrected milk.
21. The shelf-stable ruminant supplement according to claim 1, wherein the ruminant administered the supplement exhibits an improved milk compositional characteristic selected from the group consisting of: an increase in milk fat(s), an increase in milk protein(s), an increase of carbohydrates in milk, an increase of vitamins in milk, an increase of minerals in milk, or combinations thereof.
22. The shelf-stable ruminant supplement according to claim 1, wherein the ruminant administered the supplement exhibits at least a 1% increase in the average production of: milk fat(s), milk protein(s), energy-corrected milk, or combinations thereof.
23. The shelf-stable ruminant supplement according to claim 1, wherein the ruminant administered the supplement exhibits at least a 10% increase in the average production of: milk fat(s), milk protein(s), energy-corrected milk, or combinations thereof.
24. The shelf-stable ruminant supplement according to claim 1, wherein the ruminant administered the supplement exhibits at least a 20% increase in the average production of: milk fat(s), milk protein(s), energy-corrected milk, or combinations thereof.
25. A composition suitable for administration to a ruminant and capable of increasing milk production or improving milk compositional characteristics in a ruminant, comprising:
    a) a purified population of fungi as deposited at NRRL Y-67249; and
    b) a carrier suitable for ruminant administration,
    wherein the purified population of fungi of a) is present in the composition in an amount effective to increase milk production or improve milk compositional characteristics in a ruminant administered the composition, as compared to a ruminant not administered the composition.
26. A composition suitable for administration to a ruminant and capable of increasing milk production or improving milk compositional characteristics in a ruminant, comprising:
    a) a purified population of fungi as deposited at NRRL Y-67249;
    b) a purified population of bacteria as deposited at NRRL B-67248; and
    c) a carrier suitable for ruminant administration,
    wherein the purified population of fungi of a) and purified population of bacteria of b) are present in the composition in an amount effective to increase milk production or improve milk compositional characteristics in a ruminant administered the composition, as compared to a ruminant not administered the composition.

The aforementioned compositions have markedly different characteristics and/or properties not possessed by any individual bacteria or fungi as they naturally exist in the rumen. The markedly different characteristics and/or properties possessed by the aforementioned compositions can be structural, functional, or both. For example, the compositions possess the markedly different functional property of being able to increase milk production or improve milk compositional characteristics, when administered to a ruminant, as taught herein. Furthermore, the compositions possess the markedly different functional property of being shelf-stable.

Numbered Embodiments of the Disclosure

Subject matter contemplated by the present disclosure is set out in the following numbered embodiments:
1. A composition capable of modulating the rumen microbiome of a ruminant, comprising:
    a) a purified population of Pichia fungi comprising a fungi with an ITS nucleic acid sequence that is at least about 97% identical to SEQ ID NO: 32; and
    b) a carrier suitable for ruminant administration,
    wherein the purified population of *Pichia* fungi of a) is present in the composition in an amount effective to cause a shift in the microbiome of the rumen of a ruminant administered the composition.
2. The composition according to claim 1, wherein a population of microbes present in the ruminant's rumen before administration of the composition increase in abundance after administration of the composition.
3. The composition according to claim 1, wherein a population of microbes present in the ruminant's rumen before administration of the composition decrease in abundance after administration of the composition.
4. The composition according to claim 1, wherein a first population of microbes present in the ruminant's rumen before administration of the composition increase in abundance after administration of the composition and wherein a second population of microbes present in the ruminant's rumen before administration of the composition decrease in abundance after administration of the composition.
5. The composition according to claim 1, wherein the rumen microbiome of the ruminant administered the composition is shifted to include an increased presence of fiber-degrading genera, volatile fatty acid-producing genera, structural carbohydrate-digesting genera, or combinations thereof.
6. The composition according to claim 1, wherein the rumen microbiome of the ruminant administered the composition is shifted according to the disclosure and data presented in Example 6 and Table 13 or Table 14.
7. A method for modulating the rumen microbiome of a ruminant, comprising administering to a ruminant an effective amount of a composition comprising:
 a) a purified microbial population, said purified microbial population comprising:
  i. a purified population of bacteria that comprises a bacteria with a 16S nucleic acid sequence that is at least about 97% identical to a nucleic acid sequence selected from the group consisting of: SEQ ID NOs: 1-30 and 2045-2103, and/or
  ii. a purified population of fungi that comprises a fungi with an ITS nucleic acid sequence that is at least about 97% identical to a nucleic acid sequence selected from the group consisting of: SEQ ID NOs: 31-60 and 2104-2107; and
 b) a carrier suitable for ruminant administration,
 wherein the ruminant administered the effective amount of the composition exhibits a shift in the microbiome of the rumen.
8. The method according to claim 7, wherein a population of microbes present in the ruminant's rumen before administration of the composition increase in abundance after administration of the composition.
9. The method according to claim 7, wherein a population of microbes present in the ruminant's rumen before administration of the composition decrease in abundance after administration of the composition.
10. The method according to claim 7, wherein a first population of microbes present in the ruminant's rumen before administration of the composition increase in abundance after administration of the composition and wherein a second population of microbes present in the ruminant's rumen before administration of the composition decrease in abundance after administration of the composition.
11. The method according to claim 7, wherein the rumen microbiome of the ruminant administered the composition is shifted to include an increased presence of fiber-degrading genera, volatile fatty acid-producing genera, structural carbohydrate-digesting genera, or combinations thereof.
12. The method according to claim 7, wherein the rumen microbiome of the ruminant administered the composition is shifted according to the disclosure and data presented in Example 6 and Table 13 or Table 14.

The aforementioned compositions have markedly different characteristics and/or properties not possessed by any individual bacteria or fungi as they naturally exist in the rumen. The markedly different characteristics and/or properties possessed by the aforementioned compositions can be structural, functional, or both. For example, the compositions possess the markedly different functional property of being able to modulate the rumen microbiome, when administered to a ruminant, as taught herein.

Numbered Embodiments of the Disclosure

Subject matter contemplated by the present disclosure is set out in the following numbered embodiments:
1. A method for increasing milk production or improving milk compositional characteristics in a ruminant, comprising:
 a) administering to a ruminant an effective amount of a shelf-stable ruminant supplement comprising:
  i. a purified microbial population that comprises a bacteria with a 16S nucleic acid sequence, and/or a fungi with an ITS nucleic acid sequence, which is at least about 97% identical to a nucleic acid sequence selected from the group consisting of: SEQ ID NOs: 1-60 and 2045-2107, said bacteria having a MIC score of at least about 0.4 and said fungi having a MIC score of at least about 0.2; and
  ii. a shelf-stable carrier suitable for ruminant administration,
 wherein at least one of the bacteria or fungi are capable of converting a carbon source into a volatile fatty acid selected from the group consisting of: acetate, butyrate, propionate, or combinations thereof; and
 wherein at least one of the bacteria or fungi are capable of degrading a soluble or insoluble carbon source; and
 wherein the ruminant administered the effective amount of the shelf-stable ruminant supplement exhibits an increase in milk production or improved milk compositional characteristics, as compared to a ruminant not administered the ruminant supplement.
2. The method according to claim 1, wherein the ruminant is a cow.
3. The method according to claim 1, wherein the ruminant supplement is stable under ambient conditions for at least one week.
4. The method according to claim 1, wherein the ruminant supplement is formulated as an: encapsulation, tablet, capsule, pill, feed additive, food ingredient, food additive, food preparation, food supplement, consumable solution, consumable spray additive, consumable solid, consumable gel, injection, suppository, bolus, drench, or combinations thereof.

5. The method according to claim 1, wherein the ruminant supplement is encapsulated in a polymer or carbohydrate.

6. The method according to claim 1, wherein administering comprises: feeding the ruminant supplement to a ruminant.

7. The method according to claim 1, wherein administering comprises: injecting the ruminant supplement into a ruminant.

8. The method according to claim 1, wherein the purified microbial population is present in the ruminant supplement at a concentration of at least $10^2$ cells.

9. The method according to claim 1, wherein the purified microbial population comprises a bacteria with a 16S nucleic acid sequence that is at least about 97% identical to a nucleic acid sequence selected from the group consisting of: SEQ ID NOs: 1-30 and 2045-2103.

10. The method according to claim 1, wherein the purified microbial population comprises a fungi with an ITS nucleic acid sequence that is at least about 97% identical to a nucleic acid sequence selected from the group consisting of: SEQ ID NOs: 31-60 and 2104-2107.

11. The method according to claim 1, wherein the purified microbial population comprises a bacteria with a 16S nucleic acid sequence that is at least about 99% identical to a nucleic acid sequence selected from the group consisting of: SEQ ID NOs: 1-30 and 2045-2103.

12. The method according to claim 1, wherein the purified microbial population comprises a fungi with an ITS nucleic acid sequence that is at least about 99% identical to a nucleic acid sequence selected from the group consisting of: SEQ ID NOs: 31-60 and 2104-2107.

13. The method according to claim 1, wherein the purified microbial population comprises a bacteria with a 16S nucleic acid sequence selected from the group consisting of: SEQ ID NOs: 1-30 and 2045-2103.

14. The method according to claim 1, wherein the purified microbial population comprises a fungi with an ITS nucleic acid sequence selected from the group consisting of: SEQ ID NOs: 31-60 and 2104-2107.

15. The method according to claim 1, wherein the purified microbial population comprises a bacteria with a 16S nucleic acid sequence and a fungi with an ITS nucleic acid sequence that is at least about 97% identical to a nucleic acid sequence selected from the group consisting of: SEQ ID NOs: 1-60 and 2045-2107.

16. The method according to claim 1, wherein the purified microbial population comprises a bacteria with a 16S nucleic acid sequence that is at least about 97% identical to SEQ ID NO: 28.

17. The method according to claim 1, wherein the purified microbial population comprises a fungi with an ITS nucleic acid sequence that is at least about 97% identical to SEQ ID NO: 32.

18. The method according to claim 1, wherein the purified microbial population comprises a *Pichia* fungi as deposited at NRRL Y-67249.

19. The method according to claim 1, wherein the purified microbial population only contains organisms that are members of a group selected from:

*Intestinimonas, Anaerolinea, Pseudobutyrivibrio, Olsenella, Eubacterium, Catenisphaera, Faecalibacterium, Solobacterium, Blautia, Ralsonia, Coprococcus, Casaltella, Anaeroplasma, Acholeplasma, Aminiphilus, Mitsuokella, Alistipes, Sharpea, Oscillibacter, Neocallimastix, Odoribacter, Pichia, Tannerella, Candida, Hydrogenoanaerobacterium, Orpinomyces, Succinivibrio, Sugiyamaella, Ruminobacter, Lachnospira, Caecomyces, Sinimarinibacterium, Tremella, Hydrogenoanaerobacterium, Turicibacter, Clostridium_XIVa, Anaerolinea, Saccharofermentans, Butyricicoccus, Olsenella, Papillibacter, Clostridium XIa, Pelotomaculum, Erysipelotrichaceae incertae sedis, Lachnospiracea_incertae_sedis, Solobacterium, Anaeroplasma, Ralstonia, Clostridium_sensu_stricto, Eubacterium, Rikenella, Lachnobacterium, Tannerella, Acholeplasma, Howardella, Selenomonas, Butyricimonas, Sharpea, Succinivibrio, Ruminobacter, Candida, Syntrophococcus, Pseudobtqrivibrio, Orpinomyces, Cyllamyces, Saccharomycetales, Phyllosticta, Ascomycota,* and *Piromyces.*

20. The method according to claim 1, wherein the ruminant administered the effective amount of the ruminant supplement exhibits an increase in milk production that leads to a measured increase in milk yield.

21. The method according to claim 1, wherein the ruminant administered the effective amount of the ruminant supplement exhibits an increase in milk production and improved milk compositional characteristics that leads to a measured increase in energy-corrected milk.

22. The method according to claim 1, wherein the ruminant administered the effective amount of the ruminant supplement exhibits an improved milk compositional characteristic selected from the group consisting of: an increase in milk fat(s), an increase in milk protein(s), an increase of carbohydrates in milk, an increase of vitamins in milk, an increase of minerals in milk, or combinations thereof.

23. The method according to claim 1, wherein the ruminant administered the effective amount of the ruminant supplement exhibits at least a 1% increase in the average production of: milk fat(s), milk protein(s), energy-corrected milk, or combinations thereof.

24. The method according to claim 1, wherein the ruminant administered the effective amount of the ruminant supplement exhibits at least a 10% increase in the average production of: milk fat(s), milk protein(s), energy-corrected milk, or combinations thereof.

25. The method according to claim 1, wherein the ruminant administered the effective amount of the ruminant supplement exhibits at least a 20% increase in the average production of: milk fat(s), milk protein(s), energy-corrected milk, or combinations thereof.

26. The method according to claim 1, wherein the ruminant administered the effective amount of the ruminant supplement, further exhibits:

at least one improved phenotypic trait, selected from the group consisting of: an improved efficiency in feed utilization, improved digestibility, an increase in polysaccharide and lignin degradation, an increase in fatty acid concentration in the rumen, pH balance in the rumen, a reduction in methane emissions, a reduction in manure production, improved dry matter intake, an improved efficiency of nitrogen utilization, or combinations thereof.

27. The method according to claim 1, wherein the ruminant administered the effective amount of the ruminant supplement, further exhibits: a shift in the microbiome of the rumen.

28. The method according to claim 1, wherein the ruminant administered the effective amount of the ruminant supplement, further exhibits: a shift in the microbiome of the rumen, wherein a population of microbes present in the rumen before administration of the ruminant supplement increase in abundance after administration of the ruminant supplement.

29. The method according to claim 1, wherein the ruminant administered the effective amount of the ruminant supplement, further exhibits: a shift in the microbiome of the rumen, wherein a population of microbes present in the rumen before administration of the ruminant supplement decrease in abundance after administration of the ruminant supplement.

30. The method according to claim 1, wherein the ruminant administered the effective amount of the ruminant supplement, further exhibits: a shift in the microbiome of the rumen, wherein a first population of microbes present in the rumen before administration of the ruminant supplement increase in abundance after administration of the ruminant supplement, and wherein a second population of microbes present in the rumen before administration of the ruminant supplement decrease in abundance after administration of the ruminant supplement.

The aforementioned compositions, utilized in the described methods, have markedly different characteristics and/or properties not possessed by any individual bacteria or fungi as they naturally exist in the rumen. The markedly different characteristics and/or properties possessed by the aforementioned compositions, utilized in the described methods, can be structural, functional, or both. For example, the compositions, utilized in the described methods, possess the markedly different functional property of being able to increase milk production or improve milk compositional characteristics, when administered to a ruminant, as taught herein. Furthermore, the compositions, utilized in the described methods, possess the markedly different functional property of being shelf-stable.

In aspects, the aforementioned microbial species—that is, a purified microbial population that comprises a bacteria with a 16S nucleic acid sequence, and/or a fungi with an ITS nucleic acid sequence, which is at least about 97% identical to a nucleic acid sequence selected from the group consisting of: SEQ ID NOs: 1-60 and 2045-2107—are members of a Markush group, as the present disclosure illustrates that the members belong to a class of microbes characterized by various physical and functional attributes, which can include any of the following: a) the ability to convert a carbon source into a volatile fatty acid such as acetate, butyrate, propionate, or combinations thereof; b) the ability to degrade a soluble or insoluble carbon source; c) the ability to impart an increase in milk production or improved milk compositional characteristics to a ruminant administered the microbe; d) the ability to modulate the microbiome of the rumen of a ruminant administered the microbe; e) the ability to be formulated into a shelf-stable composition; and/or f) possessing a MIC score of at least about 0.4 if a bacteria and possessing a MIC score of at least about 0.2 if a fungi. Thus, the members of the Markush group possess at least one property in common, which can be responsible for their function in the claimed relationship.

TABLE 25

Budapest Treaty Deposits of the Disclosure

| Depository | Accession Number | Date of Deposit |
|---|---|---|
| NRRL | NRRL Y-67249 | Apr. 27, 2016 |
| NRRL | NRRL B-67248 | Apr. 27, 2016 |
| NRRL | NRRL B-67347 | Dec. 15, 2016 |
| NRRL | NRRL B-67348 | Dec. 15, 2016 |
| NRRL | NRRL B-67349 | Dec. 15, 2016 |
| Bigelow | PATENT201612001 | Dec. 12, 2016 |
| Bigelow | PATENT201612002 | Dec. 12, 2016 |
| Bigelow | PATENT201612003 | Dec. 12, 2016 |
| Bigelow | PATENT201612004 | Dec. 12, 2016 |
| Bigelow | PATENT201612005 | Dec. 12, 2016 |
| Bigelow | PATENT201612006 | Dec. 12, 2016 |
| Bigelow | PATENT201612007 | Dec. 15, 2016 |
| Bigelow | PATENT201612008 | Dec. 15, 2016 |
| Bigelow | PATENT201612009 | Dec. 15, 2016 |
| Bigelow | PATENT201612010 | Dec. 15, 2016 |
| Bigelow | PATENT201612011 | Dec. 15, 2016 |
| Bigelow | PATENT201612012 | Dec. 15, 2016 |
| Bigelow | PATENT201612013 | Dec. 19, 2016 |
| Bigelow | PATENT201612014 | Dec. 28, 2016 |

INCORPORATION BY REFERENCE

All references, articles, publications, patents, patent publications, and patent applications cited herein are incorporated by reference in their entireties for all purposes.

However, mention of any reference, article, publication, patent, patent publication, and patent application cited herein is not, and should not be taken as, an acknowledgment or any form of suggestion that they constitute valid prior art or form part of the common general knowledge in any country in the world.

SEQUENCE LISTING (2107 sequences)

SEQ ID NO: 1 - DNA, 225 bp, Unknown
  Encodes 16S rRNA from Clostridium
agagtttgatcctggctcaggatgaacgctggcggcgtgcctaacacatgcaagtcgaacggaacttctttgacagaattcttcggaaggaagttgattaagtttagtggcggacgggtgagtaacgcgtgagtaacctgcctttgagaggggaataacttcccgaaagggatgctaataccgcataaagcatagaagtcgcatggcttttatgccaaagattta

SEQ ID NO: 2 - DNA, 225 bp, Unknown
  Encodes 16S rRNA from Ruminococcus
agagtttgatcatggctcaggacgaacgctggcggcgtgcctaacacatgcaagtcgaacggaactattttgactgattccttcgggatgaagaatttttagtttagtggcggacgggtgagtaacgcgtgagtaacctgcctctgagaggggaataacgttctgaaaagaacgctaataccgcataacacatatttgccgcatgacagatatgtcaaagatttt

SEQ ID NO: 3 - DNA, 225 bp, Unknown
  Encodes 16S rRNA from Clostridium
agagtttgatcatggctcaggatgaacgctggcggcgtgcctaacacatgcaagtcgaacgaagctcgatcctcggagatttcggtcaaagaggaaagatgacttagtggcggacgggtgagtaatgcgtgagcaacctgccttggagtgggggacaacagttggaaacgactgctaataccgcataatgtatttggggggcatcctctgaataccaaagattta

SEQ ID NO: 4 - DNA, 225 bp, Unknown
  Encodes 16S rRNA from Roseburia
agagtttgatcctggctcaggatgaacgctggcggcgtgcttaacacatgcaagtcgaacgaggttcctatttacgatcccttcggggtgacgagtttgaaccgagtggcggacgggtgagtaacgcgtggggaacctgcctcatgccgggggataccagagggaaacttctgttaataccgcataagcgcacggtgtggcatcacacagtgtgaaaaactccgg

SEQ ID NO: 5 - DNA, 225 bp, Unknown
  Encodes 16S rRNA from Hydrogenoanaerobacterium
agagtttgatcatggctcaggacgaacgctggcggcgtgcctaacacatgcaagtcgaacgaagcatttggagctgatctcttcggagtgacgcaccttatgacttagtggcggacgggtgagtaacacgtgagcaacctgcctttcagagtggaataacagttggaaacggctgctaataccgcataacgtcatagtaccgcatgataccttgaccaaagattt

SEQ ID NO: 6 - DNA, 225 bp, Unknown
  Encodes 16S rRNA from Clostridium
agagtttgatcatggctcaggatgaacgctggcggcgtgcctaacacatgcaagttgaacgaagcaatcaagacagaatccttcgggaggaagatttgattgactgagtggcggacgggtgagtaacgcgtgggtaacctgccttgtacagggggataacagttagaaatgactgctaataccgcataagcgcacagtactgcatggtacagtgtgaaaaactcc

SEQ ID NO: 7 - DNA, 225 bp, Unknown
  Encodes 16S rRNA from Saccharofermentans
agagtttgatcatggctcaggatgaacgctggcggcgtgcctaacacatgcaagtcgaacggagttacgagagcttgcttttgtaacttagtggcggacgggtgagtaatgtatgagcaacctgcctttcagagggggacaacagttggaaacgactgctaataccgcataatgtatttgggtggcatcacctggataccaaaggagcaatccgctgaaagatgg

SEQ ID NO: 8 - DNA, 225 bp, Unknown
  Encodes 16S rRNA from Saccharofermentans
agagtttgatcatggctcaggatgaacgctggcggcgtgcttaacacatgcaagtcgaacggggtttaagaaggaagcttgctttcattttaaacctagtggcggacgggtgagtaacgcgtgaggaacctgcccttcagtggggaacaacaactagaaatggttgctaataccgcataatgtcggagagccgcatgacattccgaccaaaggatttattcgctg

SEQ ID NO: 9 - DNA, 225 bp, Unknown
  Encodes 16S rRNA from Butyricicoccus
agagtttgatcatggctcaggacgaacgctggcggcatgcctaacacatgcaagtcgaacggagatattgagagcttgcttttgatatcttagtggcggacgggtgagtaacgcgtgagcaacctgcctttcagtggggaataatacttcgaaagaggtactaataccgcataacgtattgagatcgcatggttttgataccaaagatttatcgctgagagatgg

SEQ ID NO: 10 - DNA, 225 bp, Unknown
  Encodes 16S rRNA from Papillibacter
agagtttgatcatggctcaggatgaacgctggcggcgtgcctaacacatgcaagtcgaacgaagcactttggatggagattcgtcaaaatctgatttgacttagtggcggacgggtgagtaatgtgtgagcaacctgcctttcagagggggacaacagttggaaacggctgctaataccgcataatgtatattgagggcatcctcgatataccaaaggagcaatc

SEQ ID NO: 11 - DNA, 225 bp, Unknown
  Encodes 16S rRNA from Ruminococcus
agagtttgatcatggctcaggacgaacgctggcggcgtgcctaacacatgcaagtcgaacggagttgaggagcttgctccttaacttagtggcggacgggtgagtaacgcgtgagtaacctgcctctgagaggggaataacgttctgaaaagaacgctaataccgcatgacacatatttgccgcatgacagatatgtcaaagattttatcgctcagagatggact

SEQ ID NO: 12 - DNA, 225 bp, Unknown
  Encodes 16S rRNA from Hydrogenoanaerobacterium
agagtttgatcatggctcaggacgaacgctggcggcacgcttaacacatgcaagtcgaacggagtttagagagcttgctttttaaacttagtggcggacgggtgagtaacacgtgagcaacctgccttcaagcgaggaataatgagtggaaacgctctgtaatacctcataacgtatttttaccgcatgataggaataccaaagatttatcacttgaagatgggc

SEQ ID NO: 13 - DNA, 225 bp, Unknown
  Encodes 16S rRNA from Pelotomaculum
agagtttgatcatggctcaggacgaacgctggcggcgtgcctaacacatgcaagtcgaacggagtaagaatttcggtttttacttagtggcgaacgggtgagtaacgcgtgaacaacctgccttcctgagggggataacacctggaaacaagtgctaataccgcataagaccacatgtccgcatggacgaggggtcaaaggagcaatccgcagggagaggggttc

SEQ ID NO: 14 - DNA, 225 bp, Unknown
  Encodes 16S rRNA from Saccharofermentans
agagtttgatcatggctcaggatgaacgctggcggcgtgcctaacacatgcaagtcgagcggagttatgagaggtgcttgcaccacttttaacttagcggcggacgggtgagtaacacgtgagtaacctgcccttgagtggggaacaacatcgagaaatcggtgctaataccgcataatatctctttgccgcatgacagagagatcaaaggatttattcgcttga

SEQ ID NO: 15 - DNA, 225 bp, Unknown
  Encodes 16S rRNA from Lachnospiraceae incertae sedis
agagtttgatcatggctcaggatgaacgctggcggcgtgcttaacacatgcaagtcgaacggagttatcaatgaaacctagtgatttgataacttagtggcggacgggtgagtaacgcgtgggtaacctgccttatccggggggataacagttagaaatgactgctaataccgcataagcgcacagaatcgcatgattccgtgtgaaaagatttatcgggataag

SEQ ID NO: 16 - DNA, 225 bp, Unknown
  Encodes 16S rRNA of Butyricicoccus - sensu stricto
agagtttgatcatggctcaggacgaacgctggcggcatgcctaacacatgcaagtcgaacggagtttaaggggcttgctccttaaacttagtggcggacgggtgagtaacgcgtgagcaacctgcctctcagtggggaataatgtactgaaaaggacactaataccgcatgacgtaccggagtcgcatggcactggtaccaaagatttatcgctgagagatgggc

SEQ ID NO: 17 - DNA, 225 bp, Unknown
  Encodes 16S rRNA from Lachnospiraceae incertae sedis
agagtttgatcatggctcaggatgaacgctggcggcgtgcttaacacatgcaagtcgaacggagtttagatgaaagcttgcttttgactaaacttagtggcggacgggtgagtaacgcgtgggtaacctgccttataccgggggacaacagttggaaacggctgctaataccgcataagcgcacgaggaggcatctcctagtgtgaaaaactccggtggtataag

SEQ ID NO: 18 - DNA, 225 bp, Unknown
  Encodes 16S rRNA from Anaeroplasma
agagtttgatcatggctcaggattaacgctggcggcgtgcctaatacatgcaagtcgaatggtagcaataccatggcgaacgggtgagtaacacgtaggtaacctgtctttaagacgaggataaccgttggaaacgacggataatactcgataggtgattttagggcatcctagaatcattaaagatttatcacttagagaggggcctgcggcgcattagctaga

SEQ ID NO: 19 - DNA, 225 bp, Unknown
  Encodes 16S rRNA from Clostridium sensu stricto
agagtttgatcatggctcaggacgaacgctggcggcgtgcctaacacatgcaagtcgagcggggacattgcgacggagacgaagtactcgtacggagtcaaagatgtaatgttctagcggcggacgggtgagtaacgcgtgagcaacctgtcccttacagggggataacacagcgaaagttgtactaataccgcatgagaccacaggatgacatcatccaggggt

SEQ ID NO: 20 - DNA, 225 bp, Unknown
  Encodes 16S rRNA from Butyricicoccus
agagtttgatcatggctcaggataaacgctggcggcgcacataagacatgcaagtcgaacggacttaaccgttagtttactaatggagcggttagtggcggactggtgagtaacgcgtaagcaatctgcctgttagagggggataacagtgagaaatcactgctaataccgcatatgctgtgaacatcacatgatgtaaacaggaaaggagcaatccgctaatag

SEQ ID NO: 21 - DNA, 225 bp, Unknown
  Encodes 16S rRNA from Butyricicoccus
agagtttgatcatggctcaggataaacgctggcggcgcacataagacatgcaagtcgaacgaacttaatcttttagtttactattagaagcggttagtggcggactggtgagtaacgcgtaaacaatctgcctatcagaggggaacaacagtgagaaatcactgctaataccgcatatgctgtgagtacggcatcgtacaaacaggaaaggagcaatccgctgat

SEQ ID NO: 22 - DNA, 225 bp, Unknown
  Encodes 16S rRNA from Rikenella
agagtttgatcatggctcaggatgaacgctagcggcaggcttaacacatgcaagtcgaggggcagcaggcggtagcaataccgtgctggcgaccggcgcacgggtgcgtaacgcgtatgcaacctacccactacagggggataacggagggaaacttccactaatatcccatggagttgttttttcgcatggagagacaactaaagctacggtggtagtggatgg

SEQ ID NO: 23 - DNA, 225 bp, Unknown
  Encodes 16S rRNA from Tannerella
agagtttgatcatggctcaggatgaacgctagcggcaggcttaacacatgcaagtcgaggggcagcggggtgtagcaatacactgccggcgaccggcgcacgggtgcgtaacgcgtatgcaacctgcccgtaacagggggataactcggggaaacccgaactaataccccgtattgacaaggggccgcatggtcttttgtcgaaagcttcggtggttacggatgg

SEQ ID NO: 24 - DNA, 225 bp, Unknown
  Encodes 16S rRNA from Howardella
agagtttgatcatggctcaggataaacgctggcggcgcacataagacatgcaagtcgaacggaagtcgttgtaatgatgtggacatgaacggagaacttgttcaaagagagtgaaaattgacttacaacaatggctttagtggcggactggtgagtaatgtataagtaacctgcctatcagaggggaacaacagttggaaacgactgctaataccgcatatgcca

SEQ ID NO: 25 - DNA, 225 bp, Unknown
  Encodes 16S rRNA from Prevotella
agagtttgatcatggctcaggatgaacgctagcggcaggcttaacacatgcaagtcgaggggcagcgtggagtagcaatactctgacggcgaccggcgaaagggtgagtaacgcgtgagcaacatgcccgtagttgggggatagtcgatggaaacgtcgcgtaataccccgtaacaacagaggccgcatgacctttgtttaagagatttattgtctacggattgg

SEQ ID NO: 26 - DNA, 225 bp, Unknown
  Encodes 16S rRNA from Butyricimonas
agagtttgatcatggctcaggatgaacgctagcggcaggcttaacacatgcaagtcgaggggcagcgggtgtagcaatacatgccggcgaccggcgaaagggtgagtaacgcgtgagcaacgtgcccgtatgtgggggatagtcgatggaaacgtcgcgtaataccccgtaacacattttcccgcatgggaatatgttgaaagatttattgcatacggatcggct

SEQ ID NO: 27 - DNA, 225 bp, Unknown
  Encodes 16S rRNA from Clostridium sensu stricto
agagtttgatcatggctcaggacgaacgctggcggcgtgcctaacacatgcaagtcgagcggggacatgcgacggataggaagttttcggatggaattgaagatgtatgttctagcggcggacgggtgagtaacgcgtgagcaacctgtccttcacagggggataacacagcgaaagttgtactaataccgcataagaccacagtgagacatctcacaggggtca

SEQ ID NO: 28 - DNA, 225 bp, Unknown
  Encodes 16S rRNA from Clostridium sensu stricto
agagtttgatcctggctcaggacgaacgctggcggcgtgcttaacacatgcaagtcgagcgatgaagttccttcgggaatggattagcggcggacgggtgagtaacacgtgggtaacctgcctcatagaggggaatagcctttcgaaaggaagattaataccgcataagattgtagcaccgcatggtgcagcaattaaaggagtaatccgctatgagatggaccc

SEQ ID NO: 29 - DNA, 225 bp, Unknown
  Encodes 16S rRNA from Saccharofermentans
agagtttgatcctggctcaggatgaacgctggcggcgtgcctaacacatgcaagtcgaacggagttactagagcttgctttggtaacttagtggcggacgggtgagtaatgtatgagcaacctgcctttcagagggggacaacagttggaaacgactgctaataccgcataatgtgcgaagggggcatcccttttgtaccaaaggagcaatccgctgaaagatgg

SEQ ID NO: 30 - DNA, 225 bp, Unknown
  Encodes 16S rRNA from Lachnospiraceae incertae sedis
agagtttgatcatggctcaggatgaacgctggcggcgtgcttaacacatgcaagtcgaacgaagcatttttcgattcttcggaaaagaggaatgactgagtggcggacgggtgagtaacgcgtgggaaacctgccttataccgggggatagcagttggaaacgactggtaaaaccgcataagcgcacgggtacgcatgtatctgtgtgaaaaactctggtggtat

SEQ ID NO: 31 - DNA, 225 bp, Unknown
  ITS2 sequence of Pyromyces
tcctccgcttattgatatgcttaagttcagcgggtactcttatctgatttgagatcaagttatttaattaaattttcctttgttggattttttctaaaaaaatacaaaattgtttaggttattcctttttacgggaaaattttatccaattttatattaaaattagaaaaaatttcaataatcaaaaaatttaaagtgaaacaacttgtatcgttgtaaaacact

SEQ ID NO: 32 - DNA, 225 bp, Unknown
  ITS2 sequence of Candida xylopsoci
tcctccgcttattgatatgcttaagttcagcgggtattcctacctgatttgaggtcgagctttttgttgtctcgcaacactcgctctcggccgccaagcgtccctgaaaaaaagtctagttcgctcggccagcttcgctccctttcaggcgagtcgcagctccgacgctctttacacgtcgtccgctccgctcccccaactctgcgcacgcgcaagatggaaacg

SEQ ID NO: 33 - DNA, 225 bp, Unknown
  ITS2 Sequence of Orpinomyces
tcctccgcttattgatatgcttaagttcagcgggtactcttatctgatttgagatcaagttagttttataattaaatttccttttttgtaggtcaatttaagttttaactttaaaactgaaaagtttattcctttttacgggaaaattttatccaattttaaaaataaaaccaaattggcttattaaaaaaatcaatttaaagtgaaacaacttgttatcgttgt

SEQ ID NO: 34 - DNA, 225 bp, Unknown
  ITS2 sequence of Orpinomyces
tcctccgcttattgatatgcttaagttcagcgggtactcttatctgatttgagatcaagttatttataaataaatttcctttaactgtacggtatggaaactattaaaatttctaaaaaactgaaatagctttattcctttttacgggaaaattttatccaattttttaaaaaaattaaaatcgttccaaccgacgatttcaattaaaatccatttaaagtgaaa

SEQ ID NO: 35 - DNA, 225 bp, Unknown
  ITS2 sequence of Orpinomyces
tcctccgcttattgatatgcttaagttcagcgggtactcttatctgatttgagatcaagttagtttataaattaaatttccttttttcaaggtcaatttaggattttatttttaaaactgaaaagtttattcctttttacgggaaaattttatccaattttaataataaaaccaaattggctttttaaaaaatcaatttaaagtgaaacaacttgttatcgttgt

SEQ ID NO: 36 - DNA, 225 bp, Unknown
  ITS2 sequence of Candida apicol
tcctccgcttattgatatgcttaagttcagcgggtagccttgcttgattggaggccaaaagattgtaagtaactgcacagagttatctaacgtgtgcacttccattcttttgactcctaaaaggagcagaacctcgtactacaatgaagtagtatgagagaaagatcggcgctccaacaagcatgccattaggagaacctaatggcgcaatgtgcgttcaaagat

SEQ ID NO: 37 - DNA, 225 bp, Unknown
  ITS2 sequence of Candida rugosa
tcctccgcttattgatatgcttaagttcagcgggtagtcctacctgatttgagaataagatcaagagtctgtaacaagcttaactgttttagacaatttcgtttctggcagacgcctgccggcgtggtgcccaacaccttgcgagagagaaatattgctcaaacaggcatgctgtgtggaatgccacacagcgcaatgtgcgttcaaagattcgatgattcacga

SEQ ID NO: 38 - DNA, 225 bp, Unknown
  ITS2 sequence of Neocallimastix
tcctccgcttattgatatgcttaagttcagcgggtactcttatctgatttgagatcaagttatttaaataaatttccttttaaaatcggaccgtttgttggtaataattaaaaaactgaaaagtttattcctttttacgggaaaattttatccaattttttattaaaaccataaatggtcttaaattaaaatgaatttaaagtgaaacaacttgtttatcgttgt

SEQ ID NO: 39 - DNA, 225 bp, Unknown
  ITS2 sequence of Orpinomyces
tcctccgcttattgatatgcttaagttcagcgggtactcttatctgatttgagatcaagttatttagttaaatttccttttaattaggcacaattaagttttaactattaaaactgaaaagttattcctttttacgggaaaattttatccaattttattagataaaaccaaaaattggcttttaaaaatcaatttaaagtgaaacaacttgtttatcgttgtaaa

SEQ ID NO: 40 - DNA, 225 bp, Unknown
  ITS2 sequence of Orpinomyces
tcctccgcttattgatatgcttaagttcagcgggtactcttatctgatttgagatcaagttatttataaataaatttcctttaactgtacggtatggaaactattaaaatttctaaaaaaactgaaatagcttattccttttttacgggaaaattttatccaattttttaaaaaaaattaaaatcgttcccaaccgacgatttcaattaaaatccatttaaagtg

SEQ ID NO: 41 - DNA, 225 bp, Unknown
  ITS2 sequence of Neocallimastix
tcctccgcttattgatatgcttaagttcagcgggtactcttatctgatttgagatcaagttatttaaataaatttccttttaaaatcggaccgagatttctctaactaaaactgaaaagtttattcctttttacgggaaaattttatccaattttaattattaaaaccataaaggtcttaattaaaatgaatttaaagtgaaacaacttgtttatcgttgtaaaa

SEQ ID NO: 42 - DNA, 225 bp, Unknown
  ITS2 sequence of Neocallimastix
tcctccgcttattgatatgcttaagttcagcgggtactcttatctgatttgagatcaagttatttaaattataaatttccttttaaaatcggaccgtttgttggtaataattaaaaaaactgaaaagtttattcctttttacgggaaaattttatccaatttttttttattaaaaccaaaaatggtcttaaattaaaatgaatttaaagtgaaacaacttgttta

SEQ ID NO: 43 - DNA, 225 bp, Unknown
  ITS2 sequence of Ascomycota
tcctccgcttattgatatgcttaagttcagcgggtagtcttgcttgatttgaggccaaatataaaaatatagtgttaatggctgcataactagaaccaagaatgcttagcactcgggctagtcacactgaccaccttctggctacatttagattcggtcctgagacttgaatcaaatcgcattgctgcataaaggtatgcggcactcaaacaaacatgcctcaaa

SEQ ID NO: 44 - DNA, 225 bp, Unknown
  ITS2 sequence of Piromyces
tcctccgcttattgatatgcttaagttcagcgggtactcttatctgatttgagatcaagttaatttttacttttttcctttttttatcaagaaaaatcaaaccaattttaattttttaaaattgtttaggttattcctttttacgggaaaattttatccaattttaaaaaatctttaaaattagcttttaatgattttttttgatgacaaagaatttaaagtgaa

SEQ ID NO: 45 - DNA, 225 bp, Unknown
  ITS2 sequence of Orpinomyces
tcctccgcttattgatatgcttaagttcagcgggtactcttatctgatttgagatcaagttagttttataattaaatttccttttttcaaggtcaattaggattttatttttaaaactgaaaagtttattccttttttacgggaaaattttatccaattttaataataaaaaccaaattggctttttaaaaaatcaatttaaagtgaaacaacttgttatcgttg

SEQ ID NO: 46 - DNA, 225 bp, Unknown
  ITS2 sequence of Cyllamyces
tcctccgcttattgatatgcttaagttcagcgggtactcttatctgatttgagatcaagttaatttgacttttcctttttatgtcaaaagaaatcgctaattttaatattttttaaaattgtttaggttattcctttttacaggaaaattttatccaattttaaaaaaaatctttaaaattagtttaatgattttttttgataacaaagaatttaaagtgaaaca

SEQ ID NO: 47 - DNA, 225 bp, Unknown
  ITS2 sequence of Piromyces
tcctccgcttattgatatgcttaagttcagcgggtactcttatctgatttgagatcaagttaatttgactttttccttttttaattcaaaaagaaatcaaaccaatttcatttttcttaaaattgtttaggttattccttttttacgggaaaattttatccaattttaaaaaaaatctttaaaattagtttttaaatgattttttttgataacaaagaatttaaa

SEQ ID NO: 48 - DNA, 225 bp, Unknown
  ITS2 sequence of Cyllamyces
tcctccgcttattgatatgcttaagttcagcgggtactcttatctgatttgagatcaagttaatttttacttttttttccttgttagatctttttaaaaaatcaaactaattcatttattaaaattgtttaggttattcctttttacgggaaaattttatccaattttaaaaaaaaatcagtttttaaatgattttttaataagacaaagaatttaaagtgaaac

SEQ ID NO: 49 - DNA, 225 bp, Unknown
  ITS2 sequence of Piromyces
tcctccgcttattgatatgcttaagttcagcgggtactcttatctgatttgagatcaagttatttaattaaattttcctttacttgggattttttctaaaaaaaatacaaaattgtttaggttattcctttttacgggaaaattttatccaattttatattaaaattagaaaaaatttcaataacaaaaaatttaaagtgaaacaacttgtatcgttgtaaaaca

SEQ ID NO: 50 - DNA, 225 bp, Unknown
  ITS2 sequence of Piromyces
tcctccgcttattgatatgcttaagttcagcgggtactcttatctgatttgagatcaagttaatttttactttttcctttttttatcaagaaaaatcaaaccaattttaattttttaaaattgtttaaggttattcctttttacgggaaaattttatccaattttaaaaaatctttaaaattagcttttaatgatttttttgatgacaaagaatttaaagtgaaa

SEQ ID NO: 51 - DNA, 225 bp, Unknown
  ITS2 sequence of Neocallimastix
tcctccgcttattgatatgcttaagttcagcgggtactcttatctgatttgagatcaagttatttaaaataaatttccttttaaaatcggaccgagatttctctaactaaaactgaaaagtttattcctttttacgggaaaattttatccaattttaattattaaaaccataaggtcttaaattaaaatgaatttaaagtgaaacaacttgtttatcgttataaa

SEQ ID NO: 52 - DNA, 225 bp, Unknown
  ITS2 sequence of Piromyces
tcctccgcttattgatatgcttaagttcagcgggtactcttatctgatttgagatcaagttatttttaaataaattttccttttattttgaaaaattctaattaaaaattaaaattgtttaggttattcctttttacaggaaaattttatccaattttattttaaaattagaaaaaaatttcaaattttaaaaaaatttaaagtgaaacaacttgtatcgttgta

SEQ ID NO: 53 - DNA, 225 bp, Unknown
  ITS2 sequence of Neocallimastix
tcctccgcttattgatatgcttaagttcagcgggtactcttatctgatttgagatcaagttatttaaattataaatttccttttaaaatcggaccgagatttctctaactaaaactgaaaagtttattccttttttacgggaaaattttatccaattttaattattaaaaccatattggtcttaattaaaatgaatttaaagtgaaacaacttatttatcgttgt

SEQ ID NO: 54 - DNA, 225 bp, Unknown
  ITS2 sequence of Saccharomycetales
tcctccgcttattgatatgcttaagttcagcgggtattcctacctgatctgaggtcgagctcatagtgctcggagaccccaagcgtcctgttctagttcgctcgtggcctcgtttcttttcggcggggccgtggccgggccagctctgcgcaactctcgtcttgcaagaaggaaacgacgctcagacaggcatgcccgccggaatgccgacgggcgcaatgtgcg

SEQ ID NO: 55 - DNA, 225 bp, Unknown
  ITS2 sequence of Piromyces
tcctccgcttattgatatgcttaagttcagcgggtactctcttatctgatttgagatcaagttatttaattaaattttccttttggattttttctaaaaaaatacaaaattgtttaggttattcctttttacgggaaaattttatccaattttatattaaaattagaaaaaatttcaataacaaaaaatttaaagtgaaacaacttgtatcgttgtaaaacactc

SEQ ID NO: 56 - DNA, 225 bp, Unknown
  ITS2 sequence of Orpinomyces
tcctccgcttattgatatgcttaagttcagcgggtactcttatctgatttgagatcaagttatttataaataaatttcctttaactgtaccggtatggaaattattaaaattagaaaaaatttcaataatcaaaaaatttaaagtgaaacaacttgtatcgttgtaaaacactcatcaccataaaaacaaaaaagtttttatgagaatattttactgatactcaa

SEQ ID NO: 57 - DNA, 225 bp, Unknown
  ITS2 sequence of Piromyces
tcctccgcttattgatttgcttaagttcagcgggtactcttatctgatttgagatcaagttatttaattaaattttcctttacttgggattttttctaaaaaaaatacaaaattgtttaggttattcctttttacgggaaaattttatccaattttatattaaaattagaaaaaatttcaataatcaaaaaatttaaagtaaaacaacttgtttatcgttgtaaa

SEQ ID NO: 58 - DNA, 225 bp, Unknown
  ITS2 sequence of Phyllosticta capitalensis
tcctccgcttattgatatgcttaagttcagcgggtagtcctacctgatttgaggtcagagattaagaaatattggtgttgtaagcagacactgaccactcgggtgacgaaacttattacgtcaagctaatgggtcatccactaacgcatttaaggcgagccagatggcaacgcccaagtccaagccgattaggaaaccctaatggttgatatttcatgacactca

SEQ ID NO: 59 - DNA, 225 bp, Unknown
  ITS2 sequence of Orpinomyces
tcctccgcttattgatatgcttcagttcagcgggtactcttatctgatttgagatcaagttatttataaataaatttcctttaaactgtacggtatggaaactattaaaatttctaaaaaactgaaatagtttattcctttttacgggaaaattttatccaattttttaaaaaaattaaatcgttccaaccgacgatttcaattaaaatccatttaaagtgaaac

SEQ ID NO: 60 - DNA, 225 bp, Unknown
  ITS2 sequence of Orpinomyces
tcctcgcttattgatatgcttagttcagcgggtactcttatctgatttgagatcaagttatttataaataaatttcctttaactgtacggtatggaaactaattaaaatttctaaaaaactgaaatagcttattccttttttacgggaaaattttatccaattttttaaaaaaattaaaatcgttcccaaccgacgatttcaattaaaatccatttaaagtgaaa

SEQ ID NO: 61 - DNA, 225 bp, Unknown
  Encodes 16S rRNA from Corynebacterium
agagtttgatcctggctcaggacgaacgctggcggcgtgcttaacacatgcaagtcgaacggaaaggcccagcttgctgggtgctcgagtggcgaacgggtgagtaacacgtgggtgatctgcccctaacttcgggataagcttgggaaactgggtctaataccggataggacaatcgtttagtgtcggttgtggaaagttttttcggttagggatgagcccgcg

SEQ ID NO: 62 - DNA, 225 bp, Unknown
  Encodes 16S rRNA from Prevotella
agagtttgatcatggctcaggatgaacgctagctacaggcttaacacatgcaagtcgaggggtaacatgaagaaagcttgctttctttgatgacgaccggcgcacgggtgagtatcgcgtatccaacctgcccataagtagggaatagccttgcgaaagtaagattaatgccctatggtttccattaaagacatctgagatggaataaagatttatcgcttatgg

SEQ ID NO: 63 - DNA, 225 bp, Unknown
  Encodes 16S rRNA from Comamonas
agagtttgatcctggctcagattgaacgctggcggcatgccttacacatgcaagtcgaacggtaacgggtccttcgggatgccgacgagtggcgaacgggtgagtaatacatcggaacgtgcctggtagtgggggataactactcgaaagagtggctaataccgcatgagatctcaggatgaaagcaggggaccctcgggccttgcgctatcagagcggccgatg

SEQ ID NO: 64 - DNA, 225 bp, Unknown
  Encodes 16S rRNA from Clostridium XlVa
agagtttgatcctggctcaggatgaacgctggcggcgtgcctaacacatgcaagtcgaacgagcgagagatgaaacctagtgattctcaagcgagtggcggacgggtgagtaacgcgtgggtaacctgccttacagagggggataacagtctgaaaagactgctaataccgcataagcacacagtaccgcatggtacagggtgaaaagatttatcactgtaagat

SEQ ID NO: 65 - DNA, 225 bp, Unknown
  Encodes 16S rRNA from Hippea
agagtttgatcatggctcagagttaacgctggcggcgtgcctaacacatgcaagtcgagcgaattcttacagagtatcgtaagagttagcggcaaacgggtgagtaacacatgggaaacctcccttagaatggggaacatctccgtgaaaacggagctaataccgcataagaccacagtttggcatcaaacaggggtaaaagcagcaatgcgttctaagatggtc

SEQ ID NO: 66 - DNA, 225 bp, Unknown
  Encodes 16S rRNA from Anaerovorax
agagtttgatcatggctcaggatgaacgctggcggcgtgcctaacacatgcaagtcgagcgagaaacctgtaattgacgcttcggtagattttacaggcggaaagcggcggacgggtgagtaacgcgtaggcaacctgccccatgcacagggatagcctcgggaaaccgggattaaaacctgatgataccgcattgtcacatgacggagcggtcaaagatttatc

SEQ ID NO: 67 - DNA, 225 bp, Unknown
  Encodes 16S rRNA from Clostridium XlVa
agagtttgatcatggctcaggatgaacgctggcggcgtgcctaacacatgcaagtcgaacggaaatgtttagatgaagttttcggatggattcttttcattttagtggcggacgggtgagtaacacgtgggtaacctgccctgtaccgggggataacacttagaaataggtgataataccgcataagcgcacactgacgcatgtcagagtgtgaaaaactccggt

SEQ ID NO: 68 - DNA, 225 bp, Unknown
  Encodes 16S rRNA from Rummeliibacillus
agagtttgatcctggctcaggacgaacgctggcggcgtgcctaatacatgcaagtcgagcgaatgacgaggagcttgctcctctgatttagcggcggacgggtgagtaacacgtgggtaacctgccctgtagactgggataacttcgggaaaccggagctaataccggataatccttttaacctcatggttttaagttgaaaggcgcttcggcgtcactacagga

SEQ ID NO: 69 - DNA, 225 bp, Unknown
  Encodes 16S rRNA from Clostridium XlVa
agagtttgatcctggctcaggatgaacgctggcggcgtgcctaacacatgcaagtcgaacggaaatgttttgatgaagatttcggttggattcatttcattttagtggcggacgggtgagtaacacgtgggtaacctgccctgtaccgggggataacacttagaaataggtgataataccgcataagcgcacactgacgcatgtcagagtgtgaaaaactccggt

SEQ ID NO: 70 - DNA, 225 bp, Unknown
  Encodes 16S rRNA from Lachnospiracea incertae sedis
agagtttgatcctggctcaggatgaacgctggcggcgtgcttaacacatgcaagtcgagcgaagcactctggaagattccttcgggatgattccttagtgacttagcggcggacgggtgagtaacgcgtgggcaacctgccttgtacagggggataacagttagaaatgactgctaataccgcataagcacacagcatggcatcatgcagtgtgaaaaactccgg

SEQ ID NO: 71 - DNA, 225 bp, Unknown
  Encodes 16S rRNA from Prevotella
agagtttgatcatggctcaggatgaacgctagctacaggcttaacacatgcaagtcgaggggcatcaggacggtagcttgctatcgttgctggcgaccggcgcacgggtgagtaacgcgtatccaaccttcccatgactccggttcagcccgccgaaaggcggattactcccggatggtttccgaagagggcatctgatttggaataaagattgatcggtcatgg

SEQ ID NO: 72 - DNA, 225 bp, Unknown
  Encodes 16S rRNA from Anaerovorax
agagtttgatcatggctcaggatgaacgctggcggcgtgcctaacacatgcaagtcgagcgagaaacctgcaaatgaagtttcgacagattttacaggcggaaagcggcggacgggtgagtaacgcgtaggcaacctgccccttgcacagggatagcctcgggaaaccgggattaaaacctgataacaccgcactttcacatgtaagagcggtcaaagatttatc

SEQ ID NO: 73 - DNA, 225 bp, Unknown
  Encodes 16S rRNA from Pseudoflavonifractor
agagtttgatcatggctcaggacgaacgctggcggcgtgcttaacacatgcaagtcgaacggacgatttcccttcggggagaaagttagtggcggacgggtgagtaacgcgtgagtaacctgccttggaatgggggataacacagggaaacctgtgctaataccgcataacatcgcgttggggcatcccaatgcgatcaaagatttattgttccaagatgggctc

SEQ ID NO: 74 - DNA, 225 bp, Unknown
  Encodes 16S rRNA from Prevotella
agagtttgatcatggctcaggatgaacgctagctacaggcttaacacatgcaagtcgaggggcagcatgtatctggcttgccagatatgatggcgaccggcgcacgggtgcgtaacgcgtgttcgacctaccctttactcgggaacagcccatcgaaagatggattaatgcccgatgttctccctatatcgcatggtatttggagcaaagatttatcggtagagg

SEQ ID NO: 75 - DNA, 225 bp, Unknown
  Encodes 16S rRNA from Clostridium XlVa
agagtttgatcctggctcaggatgaacgctggcggcgtgcctaacacatgcaagtcgagcggagatacttgataagcttgcttaatgagtatcttagcggcggatgggtgaggaacgcgtggagaacctgcccttcacagggggataacagctggaaacggctgttaataccgcatatgctcacagcgccgcatggcgcagggaggaaagcgcacagtggtgaag

SEQ ID NO: 76 - DNA, 225 bp, Unknown; identical to SEQ ID NO: 75
  Encodes 16S rRNA from Clostridium XlVa

SEQ ID NO: 77 - DNA, 184 bp, Unknown
  Encodes 16S rRNA from Coprococcus
agagtttgatcatggctcaggataaacgctggcggcgtgctttggacaatgggggaaaccctgatccagcgacgccgcgtgaacgatgaagtatttcggtatgtaaagttctatcagcagggaagataatgacggtacctgactaagaagcaccggctaaatacgtgccagcagccgcggtaat

SEQ ID NO: 78 - DNA, 225 bp, Unknown
  Encodes 16S rRNA from Pyramidobacter
agagtttgatcatggctcaggatgaacgctggcggcgtgcttaacacatgcaagttgcgcggggatctgacgatgagacttcggtggatttgttagatccaagcggcggacgggtgagtaaagcacaaggacgtgtccgagcgagggggacaactgcgggaaaccgtagctaataccccgtaagccgagaggtgaaagcagcaatgcgcgagcggagcgacttgt

SEQ ID NO: 79 - DNA, 225 bp, Unknown
  Encodes 16S rRNA from Syntrophococcus
agagtttgatcctggctcaggatgaacgctggcggcgtgcctaacacatgcaagtcgagcggagtgtgacgagtgcttgcacatgtcatacttagcggcggatgggtgaggaacgcgtggagaacctgcctctcacagggggataacagttggaaacgactgttaataccgcatatgctcacggtgccgcatggcacagggaggaaagatttcatcggtgagaga

SEQ ID NO: 80 - DNA, 225 bp, Unknown
  Encodes 16S rRNA from Prevotella
agagtttgatcctggctcaggatgaacgctagctacaggcttaacacatgcaagtcgaggggcagcatgttgtgtgcttgcacacaatgatggcgaccggcgcacgggtgagtaacgcgtatccaaccttcccatgactccggttcagcccgccgaaaggcggattactcccggatggtttccgaagagggcatctgatttggaataaagattgatcggtcatgg

SEQ ID NO: 81 - DNA, 225 bp, Unknown
  Encodes 16S rRNA from Clostridium XlVa
agagtttgatcctggctcaggatgaacgctggcggcgtgcctaacacatgcaagtcgaacgaagcactttggaagcttgcttttaaagtgactgagtggcggacgggtgagtaacgcgtggataacctgcctcacacagggggataacagttagaaatgactgctaataccgcatatgcctacagtaccgcatggtacaggagggaaagatttatcggtgtgaga

SEQ ID NO: 82 - DNA, 225 bp, Unknown
  Encodes 16S rRNA from Prevotella
agagtttgatcatggctcaggatgaacgctagctacaggcttaacacatgcaagtcgcggggcatcatgacgatagcttgctattgttgatggcgaccggcgcacgggtgagtaacgcgtatccaacctgcccccaagtagggcacagcccggcgaaagtcggattaattccctatgtggtcatgttatggcatcagtatatgactaaaggctttggttgcttgg

SEQ ID NO: 83 - DNA, 225 bp, Unknown
  Encodes 16S rRNA from Roseburia
agagtttgatcatggctcaggatgaacgctggcggcgtgcttaacacatgcaagtcgaacgaagcacctggtcacgatcccttcggggtgacgaccttgtgactgagtggcggacgggtgagtaacgcgtgggaaacctgccatgtactgggggataacagttggaaacgactgctaataccgcataaaactgtcggatcgcatgatctgatagccaaaactccg

SEQ ID NO: 84 - DNA, 225 bp, Unknown
  Encodes 16S rRNA from Clostridium XlVa
agagtttgatcctggctcaggatgaacgctggcggcgtgcctaacacatgcaagtcgagcggagaggttgcggagattcaatcgatgatctgcttcttcttagcggcggatgggtgagtaacacgtgggtaacctgccctgcactggggaataacagttggaaacgactgttaataccgcatatgcgcacggggtcgcatgaccccgggcggaaagatttatcgg

SEQ ID NO: 85 - DNA, 225 bp, Unknown
  Encodes 16S rRNA from Lachnospiracea incertae sedis
agagtttgatcctggctcaggatgaacgctggcggcgtgcttaacacatgcaagtcgagcgaagcactctggaagattccttcgggatgattccttagtgacttagcggcggacgggtgagtaacgcgtgggcaacctgccttgtacagggggataacagttagaaatgactgctaataccgcataagcgcacagcatggcatcatgcagtgcgaaaaactccgg

SEQ ID NO: 86 - DNA, 225 bp, Unknown
  Encodes 16S rRNA from Clostridium XlVa
agagtttgatcctggctcaggatgaacgctggcggcgtgcttaatacatgcaagtcgaacggagtacttagaagaagttttcggaccaattctttgtacttagtggcggacgggtgagtaacgcgtgggtaacctgccgtatgcagggggacaacagccggaaacagctgctaataccgcataagccggcagcaccgcatggtgcagtcggaaaagatttatcgg

SEQ ID NO: 87 - DNA, 225 bp, Unknown
  Encodes 16S rRNA from Acidothermus
agagtttgatcctggctcaggatgaacgctggcggcgtgcttaacacatgcaagtcgaacgagaacgttcccttcggggaactagtaaagtggcgaacgggtgagtaacacgtgggcaacctaccccttacattgggataacgcagagaaatttgcgctaataccggatacttcgttttgagggcatcctcgttacgagaaagcttttgcggtaagggatgggcc

SEQ ID NO: 88 - DNA, 225 bp, Unknown
  Encodes 16S rRNA from Adlercreutzia
agagtttgatcctggctcaggatgaacgctggcggcgtgcctaacacatgcaagtcgaacggttaaaccggcttcggccggaaatagagtggcgaacgggtgagtaacacgtgaccaacctgccccgcgcaccgggatagccccccgaaagggggattaataccggatgcgccgggagggccgcatggccctcccgggaaagcctttgcggcgcgggatggggtc

SEQ ID NO: 89 - DNA, 225 bp, Unknown
  Encodes 16S rRNA from Prevotella
agagtttgatcctggctcaggatgaacgctagctacaggcttaacacatgcaagtcgaggggcagcatgggagttgcttgcaattcccgatggcgaccggcgcacgggtgagtaacgcgtatccaaccttcccttaactccggaatagcccgctgaaaggcggattaatgccggatgcggtccagcgagggcatctgacccggaccaaaggttttctccggttaa

SEQ ID NO: 90 - DNA, 225 bp, Unknown
  Encodes 16S rRNA from Lachnospiracea incertae sedis
agagtttgatcctggctcaggatgaacgctggcggcgtgcctaacacatgcaagtcgaacggggtaaggacaccggatgaagattcgtcagattccaccgtccttacttagtggcggacgggtgagtaacgcgtgggcaacctgccctgtacaggggaatagcagctggaaacggctggtaaaaccgcatatgcgcgcagtaccgcatggtacagcgcggaaaac

SEQ ID NO: 91 - DNA, 225 bp, Unknown
  Encodes 16S rRNA from Proteiniclasticum
agagtttgatcatggctcaggacgaacgctggcggcgtgcctaacacatgcaagtcgagcggggattatgctggaaggttttcggactggaaggtatgatcttagcggcggacgggtgagtaacgcgtgagcaacctgccttcaacagggggataacgcatcgaaagatgtgctaataccgcgtaagaccatagtaccgcatggtacaggggtcaaaggagcaat

SEQ ID NO: 92 - DNA, 225 bp, Unknown
  Encodes 16S rRNA from Lachnospiracea incertae sedis
agagtttgatcctggctcaggataaacgctggcggcgtgcttaacacatgcaagtcgaacggggttatttcgagtagcttgctacatgaaataacctagtggcggacgggtgagtaacgcgtgggaaacctgcctcgtactgggggataacagttggaaacgactgttaataccgcataagcgcacgatgtcgcatgacatagtgtgaaaaactccggtggtacg

SEQ ID NO: 93 - DNA, 225 bp, Unknown
  Encodes 16S rRNA from Anaerovorax
agagtttgatcctggctcaggatgaacgctggcggcgtgcctaacacatgcaagtcgagcgtgattcactgaaatgatacttcggtagaaatttcagtgatgaaagcggcggacgggtgagtaacgcgtaggcaacctgccctttgcagggggatagccgttggaaacgacgattaaaaccccataatgcagcctgatctcctgttcgggctgccaaagatttat

SEQ ID NO: 94 - DNA, 225 bp, Unknown
  Encodes 16S rRNA from Prevotella
agagtttgatcctggctcaggatgaacgctagctacaggcttaacacatgcaagtcgaggggcagcagggcaatagcttgctattgttgctggcgaccggcgcacgggtgagtaacgcgtatccaacctaccccgcggtcagggacagcccggcgaaagtcggattaatacctgatgcagtcagaagagggcatctgattttgacgaaagattgatcgcctcggg

SEQ ID NO: 95 - DNA, 225 bp, Unknown
  Encodes 16S rRNA from Bacteroides
agagtttgatcctggctcaggatgaacgctagctacaggcctaacacatgcaagtcgcggggcagcattgaggtagcaatacctcagatggcgaccggcgcacgggtgcgtaacgcgtatccaacctggcccttactcgggtatagccctgcgaaagtaggattaatccccgatgttgtcaagatggagccttttttcttgaccaaaggcattagtcggtaaggg

SEQ ID NO: 96 - DNA, 225 bp, Unknown
  Encodes 16S rRNA from Clostridium III
agagtttgatcatggctcaggacgaacgctggcggcatgcctaacacatgcaagtcgaacggagttacaagagcttgcttttgtaacttagtggcggacgggtgagtaacgcgtgagcaacctacccttcagtggggaataatgttttgaaaagaacactaataccgcatgacatatgaccaccgcatgatggacatatcaaaggatttatttgctgaaggatgg

SEQ ID NO: 97 - DNA, 225 bp, Unknown
  Encodes 16S rRNA from Prevotella
agagtttgatcatggctcaggatgaacgctagctacaggcttaacacatgcaagtcgaggggcagcgggaggaaagcttgctttccttgccggcgaccggcgcacgggtgcgtaacgcgtatcgaacctggcccatacacggggatagtctcctgaaagggaggttaatacccggcggtcccacttggtcgcatgactgtgtgggtgaagattcatcggtatggg

SEQ ID NO: 98 - DNA, 225 bp, Unknown
  Encodes 16S rRNA from Acinetobacter
agagtttgatcatggctcagattgaacgctggcggcaggcttaacacatgcaagtcgagcggagataggtagcttgctactgattcttagcggcggacgggtgagtaatgcttaggaatctgcctattagtgggggacaacgtttcgaaagggacgctaataccgcatacgccctacgggggaaagcaggggatcttcggaccttgcgctaatagatgagcctaa

SEQ ID NO: 99 - DNA, 225 bp, Unknown
  Encodes 16S rRNA from Erysipelothrix
agagtttgatcctggctcaggataaacgctggcggcgtgcctaatacatgcaagtcgaacggacatagcttgctatgtcagtggcgaacgggtgagtaatacataagcaacctgcctacagggaccgggataacacttggaaacgagcgctaataccggataggcaggatcggggcatcctgatcctgttaaagttgagagacacaagtagatgggcttatggcg

SEQ ID NO: 100 - DNA, 225 bp, Unknown
  Encodes 16S rRNA from Bacteroides
agagtttgatcatggctcaggatgaacgctagctacaggcttaacacatgcaagtcgaggggcagcattaagtcagcttgctgatttagatggcgaccggcgcacgggtgagtaacgcgtatccaacctgccccctacccggggatagccttgcgaaagtaagattaatacccggtgcagttatgattccgcatgggaatataacgaaagattcatcggtagggg

SEQ ID NO: 101 - DNA, 225 bp, Unknown
  Encodes 16S rRNA from Clostridium XlVa
agagtttgatcctggctcaggatgaacgctggcggcgtgcctaacacatgcaagtcgaacggagatattacggatgaaggattcgtctggaatctgttttatcttagtggcggacgggtgagtaacgcgtggagaacctgcctctttccgggggatagcagttggaaacgactggtaataccgcatgagcgcacagtaccgcatggtacggggtgaaaagattta

SEQ ID NO: 102 - DNA, 225 bp, Unknown
  Encodes 16S rRNA from Butyrivibrio
agagtttgatcatggctcaggatgaacgctggcggcgtgcctaacacatgcaagtcgaacggagtttagatgaaacctagtgattctaaacttagtggcggacgggtgagtaacgcgtgggtaacctgccctatagagtgggatagcagttagaaatgactgataataccacataagaccacagtacggcatcgtacaggggtcaaagatttatcgctataggat

SEQ ID NO: 103 - DNA, 225 bp, Unknown
  Encodes 16S rRNA from Eubacterium
agagtttgatcctggctcaggatgaacgctggcggcgtgcctaacacatgcaagtcgagcgagatatccatgacgaattcttcggatgcctgaatggatggaaagcggcggacgggtgagtaacgcgtaggtaacctgccctgtacaaggggatagccactggaaacggtgattaataccttatgacaccgcagcatcacatggtgaagcggtcaaagattttat

SEQ ID NO: 104 - DNA, 225 bp, Unknown
  Encodes 16S rRNA from Prevotella
agagtttgatcctggctcaggatgaacgctagctacaggcttaacacatgcaagtcgaggggcagcatgaaggaagcttgcttcctttgatggcgaccggcgcacgggtgagtaacgcgtatccaaccttcccttaacttgggaatagcccggtgaaaaccggattaatgcccgatgtggtccagcgagggcatctgacccggaccaaagagtttttcggttaag

SEQ ID NO: 105 - DNA, 225 bp, Unknown
  Encodes 16S rRNA from Eubacterium
agagtttgatcatggctcaggatgaacgctggcggcgtgcttaacacatgcaagtcgagcgagaaacttacagatgacgcttcggttgattcagtaagcggaaagcggcggacgggtgagtaacgcgtaggcaacctgcccctggcagagggatagcatcgggaaactgatattaagacctcataacgcatccatatcacatgatgaggatgccaaagatttatc

SEQ ID NO: 106 - DNA, 225 bp, Unknown
  Encodes 16S rRNA from Prevotella
agagtttgatcatggctcaggatgaacgctagctacaggcttaacacatgcaagtcgaggggcagcatgacgagtgcttgcacttgttgatggcgaccggcgcacgggtgcgtaacgcgtatcgaaccttccccttactcgggaatagcccggtgaaaaccgaattaatgcccgatatatatttagatggcatcagaagagtatgaaagatttatcggtaaggga

SEQ ID NO: 107 - DNA, 225 bp, Unknown
  Encodes 16S rRNA from Lachnospiracea incertae sedis
agagtttgatcatggctcaggatgaacgctggcggcgtgcctaacacatgcaagtcgaacggaccttttacagactgcgattcgtcaaaggaagttcaaggttagtggcggacgggtgagtaacgcgtgggtaacctgcctcgtagagggggataacagttggaaacgattgctaataccgcataagcccacaggaccgcatggtccagggggaaaagattcatc

SEQ ID NO: 108 - DNA, 225 bp, Unknown
  Encodes 16S rRNA from Coprococcus
agagtttgatcatggctcaggatgaacgctggcggcgtgcctaacacatgcaagtcgaacggagtgttacttcttcggagggaacacttagtggcggacgggtgagtaacgcgtgggtaacctgcctcatacagggggatagcagttggaaacgactgataataccgcataagcgcacagtaccgcatggtacagtgtgaaaaactccggtggtatgagatggac

SEQ ID NO: 109 - DNA, 204 bp, Unknown
  Encodes 16S rRNA from Prevotella
agagtttgatcatggctcaggatgaacgctagctacaggctttggtcaatgggcgagagcctgaaccagccaagtagcgtgcaggatgacggccctatgggttgtaaactgcttttgtatggggataaagtgctccacgtgtggagttttgtaggtaccatacgaataaggaccggctaattccgtgccagcagccgcggtaat

SEQ ID NO: 110 - DNA, 225 bp, Unknown
  Encodes 16S rRNA from Clostridium XlVa
agagtttgatcatggctcaggatgaacgctggcggcgtgcttaacacatgcaagtcgaacgaagcattttggttcaaagccttcgggcagcgaaacttaatgacttagtggcggacgggtgagtaacgcgtgggtaacctgccttgtactgggggataacagttagaaatgactgctaataccgcataagcccacggtttcgcatggaactgtgagaaaagattt

SEQ ID NO: 111 - DNA, 225 bp, Unknown
  Encodes 16S rRNA from Prevotella
agagtttgatcatggctcaggatgaacgctagctacaggcttaacacatgcaagtcgaggggcagcatgtaggttgcttgcaacctatgatggcgaccggcgcacgggtgcgtaacgcgtatccaaccttccccgcagtagggtgcagcccgttgaaagacggattaatcccctatgttgtccattgacggcatccgatttggacgaaagatttcatcgctgcgg

SEQ ID NO: 112 - DNA, 225 bp, Unknown
  Encodes 16S rRNA from Catonella
agagtttgatcctggctcaggatgaacgctggcggcgtgcctaacacatgcaagtcgaacggaggacttcggaagaagtcttcggatggattccgatgttcttagtggcggacgggtgagtaacgcgtgggtaatctgccctgtatcggggaatagcagctggaaacggctggtaataccgcgtacgccggttggatcgcatgatccgatcgggaaactttttaa

SEQ ID NO: 113 - DNA, 225 bp, Unknown
  Encodes 16S rRNA from Methanobrevibacter
agagtttgatcatggcagaagctactgctattgggattcgattaagccatgcaagtcgaacgaatttagattcgtggcgtacggctcagtaacacgtggataacctacccttaggactgggataactctgggaaactggggctaataccggatagatgatttttcttggaatgggattttgtttaaatgttttttcgcctaaggatgggtctgcggcagattagg

SEQ ID NO: 114 - DNA, 225 bp, Unknown
  Encodes 16S rRNA from Ruminococcus
agagtttgatcctggctcaggacgaacgctggcggcacgcctaacacatgcaagtcgaacggtgaatacttagcttgctttgtattcatagtggcggacgggtgagtaacacgtgagcaacctgcctctgagagagggatagcttctggaaacggatggtaatacctcatgatatagcgttctcgcatgagaatgctatcaaacgaatttcgctcagagatgggc

SEQ ID NO: 115 - DNA, 225 bp, Unknown
  Encodes 16S rRNA from Lachnospiracea incertae sedis
agagtttgatcatggctcaggatgaacgctggcggcacgcttaacacatgcaagtcgaacgaggcgaggagtgcttgcacaccgaacctagtggcggacgggtgcgtaacgcgtgggtaacctgccctaaacagggggataacgtatagaaatgtacgctaataccgcataagctcacggaaccgcatggttttgagggaaaaggatttccggtttaggatgggc

SEQ ID NO: 116 - DNA, 184 bp, Unknown
  Encodes 16S rRNA from Coprococcus
agagtttgatcatggctcaggataaacgctggcggcgtgctttgcacaatgggggaaaccctgatgcagcgacgccgcgtgagtgatgaagtatctcggtatgtaaagctctatcagcagggaagataatgacggtacctgactaagaagcaccggctaaatacgtgccagcagccgcggtaat

SEQ ID NO: 117 - DNA, 225 bp, Unknown
  Encodes 16S rRNA from Clostridium XlVa
agagtttgatcatggctcaggatgaacgctggcggcgtgcctaacacatgcaagtcgaacgaagcacttaattacgatcccttcggggtgacgattttgtgacttagtggcggacgggtgagtaacgcgtgggtaacctgccctgtactgggggacaacagttggaaacggctgctaataccgcataagcgcacgatatcgcatggtattgtgtgaaaaactccg

SEQ ID NO: 118 - DNA, 225 bp, Unknown
  Encodes 16S rRNA from Lachnospiracea incertae sedis
agagtttgatcatggctcaggataaacgctggcggcgtgcttaacacatgcaagtcgaacggggttatttcgagaagcttgcttcatgaaataacctagtggcggacgggtgagtaacgcgtgggaaacctgcctcgtactgggggataacagttggaaacgactgttaataccgcataagcgcacaatgttgcatgacatagtgtgaaaaactccggtggtacg

SEQ ID NO: 119 - DNA, 225 bp, Unknown
  Encodes 16S rRNA from Prevotella
agagtttgatcctggctcaggatgaacgctagctacaggcttaacacatgcaagtcgcggggcagcatgttgtgtgcttgcacacaatgatggcgaccggcgcacgggtgcgtaacgcgtatccaacctgccccttactctggaatagcccggcgaaagtcggattaatgccggatgttgtcagatgaggacatctgagtttgaccaaaggcttctgccggtaag

SEQ ID NO: 120 - DNA, 225 bp, Unknown
  Encodes 16S rRNA from Anaerovorax
agagtttgatcatggctcaggatgaacgctggcggcgtgcctaacacatgcaagtcgagcgagaaacttatgattgacgcttcggttgatttcataagcggaaagcggcggacgggtgagtaacgcgtaggcaacctgccccttgcagagggatagcctcgggaaaccgggattaaaacctcataatgctgatcctacacatgtttgatcagccaaagatttatc

SEQ ID NO: 121 - DNA, 225 bp, Unknown
  Encodes 16S rRNA from Asteroleplasma
agagtttgatcctggctcaggataaacgccggcggcgtgcctaatacatgcaagtcgaacgagaggtagcaatacctcgagtggcgtacgggtgagtaacacgttgggaacctgccccagggaccggaataccagacggaaacgtctgctaatgccggatgacgatccggaagcgtcggcttccggatccaaaggcggccttcaagccgcgccacgggatggccc

SEQ ID NO: 122 - DNA, 225 bp, Unknown
  Encodes 16S rRNA from Clostridium XlVa
agagtttgatcctggctcaggatgaacgctggcggcgcgcataacacatgcaagtcgaacggagtttagatgaaacctagtgattttaaacttagtggcggacgggtgagtaacgcgtgggtaacctacctggtattgggggacaacagttagaaatgactgctaataccgcatacgacatcggagaggcatctctctgatgtgaaaggagcaatccgatagcag

SEQ ID NO: 123 - DNA, 225 bp, Unknown
  Encodes 16S rRNA from Caulobacter
agagtttgatcatggctcagaacgaacgctggcggcatgcctaacacatgcaagtcgaacgagaccttcgggtctagtggcgcacgggtgcgtaacgcgtgggaatctgcccttgggttcggaataactcgccgaaaggcgtgctaataccggatgatgtcgtaagaccaaagatttatcgcccagggatgagcccgcgtaagattaggtagttggtgaggtaaa

SEQ ID NO: 124 - DNA, 225 bp, Unknown
  Encodes 16S rRNA from Lachnospiracea incertae sedis
agagtttgatcatggctcaggataaacgctggcggcgtgcttaacacatgcaagtcgaacggggttatttcgagtagcttgctacatgaaataacctagtggcggacgggtgagtaacgcgtgggaaacctgcctcgtactgggggataacagttggaaacgactgttaataccgcataagcgcacagtgtcgcatgacacagtgtgaaaaactccggtggtacg

SEQ ID NO: 125 - DNA, 225 bp, Unknown
  Encodes 16S rRNA from Roseburia
agagtttgatcatggctcaggatgaacgctggcggcgtgcctaacacatgcaagtcgagcggacctgattgagtgattagcttgctatgaactcatgactggttagcggcggacgggtgagtaacgcgtgggtaacctgcctcatacagggggatagcagttggaaacgactggtaataccgcataagcgcacagtaccgcatggtacggtgtgaaaaactccgg

SEQ ID NO: 126 - DNA, 225 bp, Unknown
  Encodes 16S rRNA from Clostridium XlVa
agagtttgatcatggctcaggatgaacgctggcggcgtgcctaacacatgcaagtcgaacggagtatcaatgaagcctagcgatttgatacttagtggcggacgggtgagtaacgcgtggataacctgcctcacacattgggataacagttagaaatggctgctaataccgaataagcccacagtgccgcatgacacagggggaaaagattttatcggtgtgaga

SEQ ID NO: 127 - DNA, 225 bp, Unknown
  Encodes 16S rRNA from Acinetobacter
agagtttgatcctggctcagattgaacgctggcggcaggcttaacacatgcaagtcgagcggagataggtagcttgctactgattcttagcggcggacgggtgagtaatgcttaggaatctgcctattagtgggggacaacgtttcgaaagggacgctaataccgcatacgccctacgggggaaagcaggggatcttcggaccttgcgctaatagatgagcctaa

SEQ ID NO: 128 - DNA, 225 bp, Unknown
  Encodes 16S rRNA from Bacteroides
agagtttgatcatggctcaggatgaacgctagctacaggcttaacacatgcaagtcgaggggcagcattaaggaagcttgctttcttagatggcgaccggcgcacgggtgagtaacgcgtatccaacctgccccctacccggggatagccttgcgaaagtaagattaatacccggtgctgttatgattccgcatgggaatataacgaaagattcatcggtagggg

SEQ ID NO: 129 - DNA, 225 bp, Unknown
  Encodes 16S rRNA from Erysipelothrix
agagtttgatcatggctcaggatgaacgctggcggcgtgcttaatacatgcaagtcgaacgcaagcgatcacttcggtggtcaattgagtggcgaacgggtgagtaatacataaggaacctgcccgtctgactgggataacagttggaaacgactgctaataccggataggtaaccttaaggcatcttgaggttattaaagttgagatacacagacggatggcct

SEQ ID NO: 130 - DNA, 225 bp, Unknown
  Encodes 16S rRNA from Coprococcus
agagtttgatcatggctcaggatgaacgctggcggcgtgcctaacacatgcaagtcgaacggggtgtctgatcttcggactggacacttagtggcggacgggtgagtaacgcgtgggtaacctgcctcatacagggggatagcagttggaaacgactgataataccgcataagcgcacagtaccgcatggtacagtgtgaaaaactccggtggtatgagatggac

SEQ ID NO: 131 - DNA, 225 bp, Unknown
  Encodes 16S rRNA from Clostridium XlVa
agagtttgatcctggctcaggatgaacgctggcggcgtgcctaacacatgcaagtcgaacggacccaaggaagagagtagcttgctatgaacttccggaaggttagtggcggacgggtgagtaacgcgtgggcaacctgccctgtactgggggatagcagctggaaacggctggtaataccgcataagcgcacagtaccgcatggtacagtgtgaaaagctccga

SEQ ID NO: 132 - DNA, 198 bp, Unknown
  Encodes 16S rRNA from Bacteroides
agagtttgatcatggctcaggatgaacgctagctacaggcttaacacatgcaagtcgaggggcagcatgaacttagcttgctaagtttgatggcgaccggcgcacgggtgagtaacgcgtatccgaccttccctttgctcggggatagcccagtgaaaactggattaagacccgatgtagtccagcagccgcggtaat

SEQ ID NO: 133 - DNA, 225 bp, Unknown
  Encodes 16S rRNA from Coprococcus
agagtttgatcatggctcaggatgaacgctggcggcgtgcctaacacatgcaagtcgaacggggtgtcatttcttcggagacgacacttagtggcggacgggtgagtaacgcgtgggtaacctgcctcatacagggggatagcagttggaaacgactgataataccgcataagcgcacagtaccgcatggtacagtgtgaaaaactccggtggtatgagatggac

SEQ ID NO: 134 - DNA, 225 bp, Unknown
  Encodes 16S rRNA from Anaerovorax
agagtttgatcctggctcaggatgaacgctggcggcgtgcctaacacatgcaagtcgagcgagaaacttacagatgacgcttcggtcgattcagtaagcggaaagcggcggacgggtgagtaacgcgtaggcaacctgcccttcacacagggatagcctctggaaacggggattaaaacctgataacgcataactgttgcatatcagatatgccaaagatttatc

SEQ ID NO: 135 - DNA, 225 bp, Unknown
  Encodes 16S rRNA from Pseudoflavonifractor
agagtttgatcatggctcaggatgaacgctggcggcgcgcctaacacatgcaagtcgaacggtgaagtcccttcgggggcggatcagtggcggacgggtgagtaacgcgtgagtaacctgcccttacgagcggaataacgtccggaaacagacgctaataccgcatgacacgtgcttccggcatcggaggcacgtcaaagatttatcgcgtaaggatggactcgc

SEQ ID NO: 136 - DNA, 225 bp, Unknown; identical to SEQ ID NO: 135
  Encodes 16S rRNA from Pseudoflavonifractor

SEQ ID NO: 137 - DNA, 225 bp, Unknown
  Encodes 16S rRNA from Prevotella
agagtttgatcatggctcaggatgaacgctagctacaggcttaacacatgcaagtcgaggggcagcatgacgagagcttgctcttgttgatggcgaccggcgcacgggtgcgtaacgcgtatccaaccttccccctgccagggaacagcccgttgaaagacggattaatgccctatgttgtgcgaagatggcatcagatttgcacgaaagattttatcggcatgg

SEQ ID NO: 138 - DNA, 185 bp, Unknown
  Encodes 16S rRNA from Lachnospiracea incertae sedis
agagtttgatcatggctcaggatgaacgctggcggcgtgcctatgcacaatggaggaaactctgatgcagcaacgccgcgtgagtgatgaagtagttcgctacgtaaagctctatcagtagggaagataatgacggtacctacacaagaagctccggctaaatacgtgccagcagccgcggtaat

SEQ ID NO: 139 - DNA, 225 bp, Unknown
  Encodes 16S rRNA from Roseburia
agagtttgatcatggctcaggatgaacgctggcggcgtgcctaacacatgcaagtcgagcggagatgcagaacggaagccttcgggtggaagatctgttatcttagcggcggacgggtgagtaacgcgtgggtaacctggctcatacagggggataacagagagaaatttctgctaataccgcataagcgcacagcatcgcatggtgcagtgtgaaaaactccgg

SEQ ID NO: 140 - DNA, 204 bp, Unknown
  Encodes 16S rRNA from Prevotella
agagtttgatcatggctcaggatgaacgctagctacaggctttggtcaatggatgagaatctgaaccagccaagtagcgtgcaggacgacggccctatgggttgtaaactgcttttgtacggggataaaggagcttacgtgtaagtttttgcaggtaccgtacgaataaggaccggctaattccgtgccagcagccgcggtaat

SEQ ID NO: 141 - DNA, 225 bp, Unknown
  Encodes 16S rRNA from Ruminococcus
agagtttgatcatggctcaggacgaacgctggcggcacgcctaacacatgcaagtcgaacggtagatacttagcttgctttgtatctatagtggcggacgggtgagtaacacgtgagcaacctgcctctgagagagggatagcttctggaaacggatggtaatacctcatgatatagcgttctcgcatgggaatgctatcaaaagaaattcgctcagagatgggc

SEQ ID NO: 142 - DNA, 225 bp, Unknown
  Encodes 16S rRNA from Atopobium
agagtttgatcctggctcaggatgaacgctggcggcgcgcctaacacatgcaagtcgaacgattaagacaccttcgggtgtgtataaagtggcgaacggctgagtaacacgtgggcaacctacccctctctctgggatagcctcgagaaatcgtgggtaataccggatactccggatccatcgcatggtggatccgggaaagctccgacggtgagggatgggccc

SEQ ID NO: 143 - DNA, 225 bp, Unknown
  Encodes 16S rRNA from Eubacterium
agagtttgatcctggctcaggatgaacgctggcggcgtgcttaacacatgcaagtcgaacggaacttattgaatgaagttttcggatggattttgataagtttagtggcggacgggtgagtaacgcgtgggtaacctgccctgtacagggggataacagttagaaatgactgttaataccgcataagaccacagcaccgcatggtgcaggggtaaaagctccgac

SEQ ID NO: 144 - DNA, 225 bp, Unknown
  Encodes 16S rRNA from Robinsoniella
agagtttgatcctggctcaggatgaacgctggcggcgtgcctaacacatgcaagtcgaacggggtgtcagctcttcggaacggacacttagtggcggacgggtgagtaacgcgtgggtaacctgcctcatacagggggatagcagttggaaacgactgataataccgcataagcgcacagtaccgcatggtacagtgtgaaaaactccggtggtatgagatggac

SEQ ID NO: 145 - DNA, 225 bp, Unknown
  Encodes 16S rRNA from Neisseria
agagtttgatcctggctcagattgaacgctggcggcatgctttacacatgcaagtcggacggcagcatcaagaagcttgcttcttggatggcgagtggcgaacgggtgagtaatgcatcggaatgtaccgagtaatgggggataactaatcgaaagattagctaataccgcatacgacctgagggtgaaagcaggggatcttcggaccttgcgttattcgagcag

SEQ ID NO: 146 - DNA, 225 bp, Unknown
  Encodes 16S rRNA from Ruminococcus
agagtttgatcctggctcaggacgaacgctggcggcacgcttaacacatgcaagtcgaacggagataatagcttcggttattaacttagtggcggacgggtgagtaacacgtgagcaacctgccttacagagcggaataatgactggaaacggtcactaataccacataacatatggagatcgcatggtatccatatcaaagatttatcgctgtaagatgggctc

SEQ ID NO: 147 - DNA, 225 bp, Unknown
  Encodes 16S rRNA from Prevotella
agagtttgatcatggctcaggatgaacgctagctacaggcttaacacatgcaagtcgaggggcagcatgcaggaagcttgctttctgtgatggcgaccggcgcacgggtgcgtaacgcgtatccaatctaccctgcacacgggaatagccctgcgaaagtaggattaatgcccgatgttctttttttgttgcatgacagagaaagcaaagatttatcggtacagg

SEQ ID NO: 148 - DNA, 225 bp, Unknown
  Encodes 16S rRNA from Slackia
agagtttgatcatggctcaggatgaacgctggcggcgtgcttaacacatgcaagtcgaacggttaaagcccacttcggtgggtgcataaagtggcgaacgggtgagtaacacgtgaccaacccgccccccgcaccgggataaccggcggaaacgcccgctaataccggatactccgcgacggccgcatggccgacgcgggaaagcccaggcggcgggggatgggg

SEQ ID NO: 149 - DNA, 225 bp, Unknown
  Encodes 16S rRNA from Prevotella
agagtttgatcatggctcaggatgaacgctagctacaggcttaacacatgcaagtcgcggggcatcatgaagggagcttgctctctttgatggcgaccggcgcacgggtgagtaacgcgtatccaacctgccccctagtagggaacagcccgtagaaatgcggattaatgccctatgttctccgaagacggcatcagattcggagcaaaggccttttggttgcta

SEQ ID NO: 150 - DNA, 225 bp, Unknown
  Encodes 16S rRNA from Clostridium XlVa
agagtttgatcctggctcaggatgaacgctggcggcgtgcctaacacatgcaagtcgagcggagttataagagcttgcttttataacttagcggcggatgggtgaggaacgcgtggataacctgcctcacactgggggataacagctggaaacggctgttaataccgcatatgctcacagtaccgcatggtacagggaggaaagatttatcggtgtgagatggat

SEQ ID NO: 151 - DNA, 225 bp, Unknown; identical to SEQ ID NO: 100
  Encodes 16S rRNA from Bacteroides

SEQ ID NO: 152 - DNA, 225 bp, Unknown
  Encodes 16S rRNA from Anaerorhabdus
agagtttgatcatggctcaggatgaacgctggcggcgtgcctaatacatgcaagtcgaacggggtaccttcgggtacctagtggcgaacgggtgagtaacacataaacaatctgccctggagactgggataccgtcgggaaaccgacgctaataccggataggcagtaagggggcatccccatactgttaaagctgggttgcagcgctgcaggatgagtttatgt

SEQ ID NO: 153 - DNA, 225 bp, Unknown
  Encodes 16S rRNA from Bacteroides
agagtttgatcctggctcaggatgaacgctagctacaggcttaacacatgcaagtcgaggggcagcatggaagtagcttgctacttccgatggcgaccggcgaatgggtgagtaacgcgtatccaacctgccgtgtgctcatggatagcccttagaaatgaggattaatacatgatggtctcctttgatcgcctgagattgggagtaaagattcatcggcacacg

SEQ ID NO: 154 - DNA, 225 bp, Unknown
  Encodes 16S rRNA from Prevotella
agagtttgatcctggctcaggatgaacgctagctacaggcttaacacatgcaagtcgaggggcagcatgacggtagcttgctactgttgatggcgaccggcgcacgggtgagtaacgcgtatccaaccttcccacaaataaggaatagcccggtgaaaatcgaattaataccttatgtggtcataagaggacatctgattatgattaaagatttatcgtttgtgg

SEQ ID NO: 155 - DNA, 225 bp, Unknown
  Encodes 16S rRNA from Corynebacterium
agagtttgatcctggctcaggacgaacgctggcggcgtgcttaacacatgcaagtcgaacggtaaggctccagcttgctggggtacacgagtggcgaacgggtgagtaacacgtgggtgacctgccctgcacttcgggataagcctgggaaactgggtctaataccggataggactgcaccgtgagggtgtggtggaaagttttttcggtgtgggatgggcccgc

SEQ ID NO: 156 - DNA, 225 bp, Unknown
  Encodes 16S rRNA from Atopobium
agagtttgatcctggctcaggatgaacgctggcggcgcgcttaacacatgcaagtcgaacggttaaagccccttcgggggtgtataaagtggcgaacggctgagtaacacgtgggcaacctacccccctctttgggatagcctcgggaaaccgggaataataccgaatactccggacacaccgcatgatgtgaccgggaaagctccggcggagagggatgggccc

SEQ ID NO: 157 - DNA, 225 bp, Unknown
  Encodes 16S rRNA from unknown taxa
agagtttgatcctggctcaggatgaacgctggcggcatgcttaacacatgcaagtcgaacgggaagtggtgtttccagtggcgaacgggtgagtaacgcgtaagaacctgcccttgggaggggaacaacaactggaaacggttgctaataccccgtaggctgaggagcaaaaggagaaatccgcccaaggaggggctcgcgtctgattagctagttggtgaggca

SEQ ID NO: 158 - DNA, 225 bp, Unknown
  Encodes 16S rRNA from Prevotella
agagtttgatcatggctcaggatgaacgctagctacaggcttaacacatgcaagtcgcggggcagcatggaggttgcttgcaacctctgatggcgaccggcgcacgggtgagtaacgcgtatccaacctgccctgcggtagggaacagcccggcgaaagtcggattaatgccctatgtgctcatttgaaggcatctgattttgagcaaaggatttattcgccaca

SEQ ID NO: 159 - DNA, 225 bp, Unknown
  Encodes 16S rRNA from Roseburia
agagtttgatcatggctcaggatgaacgctggcggcgtgcctaacacatgcaagtcgaacgagagaggaaggtgcttgcaccgaccaatcgagtggcggacgggtgagtaacgcgtgggtaacctgcctcatacagggggataacaactggaaacggttgataataccgcataagcgcacagcatcgcatgatgcagtgtgaaaaactccggtggtatgagatgg

SEQ ID NO: 160 - DNA, 225 bp, Unknown
  Encodes 16S rRNA from Prevotella
agagtttgatcctggctcaggatgaacgctagctacaggcttaacacatgcaagtcgcggggcagcatggaggttgcttgcaacctctgatggcgaccggcgcacgggtgcgtaacgcgtatccaacctgccccttactctggaatagcccggcgaaagtcggattaatgccggatgttgtcagacgaggacatctgaatctgaccaaaggcccgaaagggttgg

SEQ ID NO: 161 - DNA, 225 bp, Unknown
  Encodes 16S rRNA from Prevotella
agagtttgatcctggctcaggatgaacgctagctacaggcttaacacatgcaagtcgaggggtagcgtgagagaagcttgcttctcttgacgacgaccggcgaatgggtgagtaacgcgtatccaacctgcccttatctcaaggatagcccttagaaatgaggattaaaacttgatagtttccattgaccgcatgggtgatggaataaagatttattggataagg

SEQ ID NO: 162 - DNA, 225 bp, Unknown
  Encodes 16S rRNA from Eubacterium
agagtttgatcctggctcaggattaacgctggcggcgtgcctaacacatgcaagtcgagcgagaaatagtgaagagatacttcggttgaacagatctatggacagcggcggacgggtgagtaacgcgtgggcaacctgcccctttccggaggatagccaagggaaactttgaataatactccataaagcagagatgtcgcatggcaattctgccaaagatttatc

SEQ ID NO: 163 - DNA, 225 bp, Unknown
  Encodes 16S rRNA from Rhodocista
agagtttgatcatggctcagaacgaacgctggcggcaggcttaacacatgcaagttgaacggtatgttgagtgcttgcacttagcagagagtagcgcactggtgagtaacacgtgggaacatgccctaaagtacgggatagcgtctggaaacggacgataatacggtatacgccctgagggggaaagatttatcgctttaggattggcccgcggcagattaggta

SEQ ID NO: 164 - DNA, 225 bp, Unknown
  Encodes 16S rRNA from Prevotella
agagtttgatcatggctcaggatgaacgctagctacaggcttaacacatgcaagtcgaggggtaacatgattggagcttgctccgattgatgacgaccggcgcacgggtgcgtaacgcgtatccaaccttccccctaccagggaatagcccgttgaaagacggattaatgccctatgttgtgtgataatggcatcagagttacacgaaagactttgtcggtatgg

SEQ ID NO: 165 - DNA, 225 bp, Unknown
  Encodes 16S rRNA from Clostridium XlVa
agagtttgatcctggctcaggatgaacgctggcggcgtgcctaacacatgcaagtcgaacggagctgcgacgctgaggagtggagtacttgtacaaagcgaatcttgtcgtagcttagtggcggacgggtgagtaacgtgtggataacctggtccatccagggggatagcagctggaaacggctggtaataccgcataagcgcacagtagggcatcctacggtgt

SEQ ID NO: 166 - DNA, 225 bp, Unknown
  Encodes 16S rRNA from Prevotella
agagtttgatcctggctcaggatgaacgctagctacaggcttaacacatgcaagtcgaggggcagcatgtcgtgtgcttgcacacgatgatggcgaccggcgcacgggtgagtaacgcgtatccaacctgcccatgactccgggatagcccgctgaaaagcggattaacaccggatgcggtcgaacgaggacatctgatttcgaccaaagcttcggcggtcatgg

SEQ ID NO: 167 - DNA, 225 bp, Unknown
  Encodes 16S rRNA from Prevotella
agagtttgatcctggctcaggatgaacgctagctacaggcttaacacatgcaagtcgaggggcagcatgtcgtgtgcttgcacacgatgatggcgaccggcgcacgggtgagtaacgcgtatccaacctgcccatgaccccgggatagcccgctgaaaagcggattaacaccggatggggtcgaacgaggacatctgatttcgaccaaagcttcggcggtcatgg

SEQ ID NO: 168 - DNA, 225 bp, Unknown
  Encodes 16S rRNA from unknown taxa
agagtttgatcatggctcaggatgaacgctggcggcatgccttacacatgcaagtcggacgggaagtggtgtttccagtggcggacgggtgagtaacgcgtaagaacctacccttgggaggggaacaacagctggaaacggctgctaataccccgtaggctgaggagcaaaaggaggaatccgcccgaggaggggctcgcgtctgattagctagttggtgaggca

SEQ ID NO: 169 - DNA, 225 bp, Unknown
  Encodes 16S rRNA from Ochrobactrum
agagtttgatcatggctcagaacgaacgctgtcgacatgctttacacatgcaagtcttacgggtataacttgttataccagtggcaaacgggtgagtaatacgtagaaatgtacccaatagtcttgaataacaattggaaacgattgataatacaagatattatggtaacataaaaggtttagtaataaactgctattggagcagtctacggtggattagattgt

SEQ ID NO: 170 - DNA, 225 bp, Unknown
  Encodes 16S rRNA from Mogibacterium
agagtttgatcatggctcaggatgaacgctggcggcgtgcctaatacatgcaagtcgagcgagaatctcctttgaagcgttttcggacaattctgtggagaggaaagcggcggacgggtgagtaacgcgtaggcaacctgcccttagcagagggatagccattggaaacgatgattaaaacctcataatgctgaagagtcacatgtctcttcagccaaagattta

SEQ ID NO: 171 - DNA, 225 bp, Unknown
  Encodes 16S rRNA from Adlercreutzia
agagtttgatcctggctcaggatgaacgctggcggcgtgcttaacacatgcaagtcgaacggttaaaccgccttcgggcggacatagagtggcgaacgggtgagtaacacgtgaccaacctgccccgcgcaccgggacagccccccgaaagggggattaataccggatactccggcggccccgcatggggcggccgggaaggctccggcggcgcgggatggggtc

SEQ ID NO: 172 - DNA, 225 bp, Unknown
  Encodes 16S rRNA from Prevotella
agagtttgatcctggctcaggatgaacgctagctacaggcttaacacatgcaagtcgaggggtaacgtgagagaagcttgcttctcttgacgacgaccggcgaatgggtgagtaacgcgtatccaacctgccgcacgcccgggaacagcccttggaaacgaggattaaatcccgataccttgtgagctcgcatgagcatacaagaaaacaggcatgcgatgggga

SEQ ID NO: 173 - DNA, 225 bp, Unknown
  Encodes 16S rRNA from Riemerella
agagtttgatcctggctcaggatgaacgctagcgggaggcctaacacatgcaagccgagcggtagaaagtagcttgctacttttgagagcggcgtacgggtgcgtaacacgtgtgcaacctgcctttatctggggaatagcctttcgaaaggaagattaatgctccataacatattgaatggcatcatttaatattgaaagctccggcggatagagatgggcacg

SEQ ID NO: 174 - DNA, 225 bp, Unknown
  Encodes 16S rRNA from Prevotella
agagtttgatcctggctcaggatgaacgctagctacaggcttaacacatgcaagtcgaggggtaacaggagggaagcttgctttcctcgctgacgaccggcgaatgggtgagtaacgcgtatccaacctgccgcacgcccgggaacagcccttggaaacgaggattaaatcccgataccttgcccttccgcatgaaggggcaagaaaacaggcatgcgatgggga

SEQ ID NO: 175 - DNA, 225 bp, Unknown
  Encodes 16S rRNA from Roseburia
agagtttgatcatggctcaggatgaacgctggcggcgtgcttaacacatgcaagtcgaacgaggtttgagcggaagcccttcgggacggaagcttttaccgagtggcggacgggtgagtaacgcgtgggtaacctgccctgtactgggggacaacagttggaaacgactgctaataccgcataagcgcacgggatcgcatggtcttgtgtgaaaaactccggtgg

SEQ ID NO: 176 - DNA, 225 bp, Unknown
  Encodes 16S rRNA from Slackia
agagtttgatcctggctcaggatgaacgctggcggcgcgcctaacacatgcaagtcgaacggtgatactttcttcggaaagaggatcagtggcgaacgggtgagtaacgcgtgggtaacctgcccttgacacagggatagcaaagggaaacttttggtaatacctgatgacctcaaaaagtgacatctctttttgagcaaagaatttcggtcgaggatggacccg

SEQ ID NO: 177 - DNA, 225 bp, Unknown
  Encodes 16S rRNA from Clostridium IV
agagtttgatcatggctcaggacgaacgctggcggcgtgcctaacacatgcaagtcgaacggagttattagagtgaagttttcggatggaatgataataacttagtggcggacgggtgagtaacgcgtgagtaacctgcccatgagagggggataacgttctgaaaagaacgctaataccgcataacatatttagttcgcatggactgaatatcaaaggagcgat

SEQ ID NO: 178 - DNA, 225 bp, Unknown
  Encodes 16S rRNA from Syntrophococcus
agagtttgatcatggctcaggatgaacgctggcggcgtgcctaacacatgcaagtcgagcggaaccataaagaagcttgctttttaatggtttagcggcggatgggtgaggaacgcgtgggcaacctgcccttcacagggggataacagctggaaacggctgttaataccgcatatgctcacgatgccgcatggcattgggaggaaaactccggtggtgaaggat

SEQ ID NO: 179 - DNA, 225 bp, Unknown
  Encodes 16S rRNA from Prevotella
agagtttgatcctggctcaggatgaacgctagctacaggcttaacacatgcaagtcgaggggtaacgtgagagaagcttgcttctcttgacgacgaccggcgaatgggtgagtaacgcgtatccaacctgccgcacgcccgggaacagcccttggaaacgaggattaaatcccgataccttatcgttccgcatggagtgataagaaaacaggcatgcgatgggga

SEQ ID NO: 180 - DNA, 225 bp, Unknown
  Encodes 16S rRNA from Treponema
agagtttgatcatggctcagaatgaacgctggcggcgggtcttaagcatgcaagtcggacggcaagggagtgcttgcactcccctagagtggcggactggtgaggaacacgttggtgacgtaccctttggatggggatagccggtagaaataccgggtaataccgaataaggtcggtggtctcggaagccaccgaggaaagcagcttcggctgcgccgaaggaac

SEQ ID NO: 181 - DNA, 225 bp, Unknown
  Encodes 16S rRNA from Prevotella
agagtttgatcatggctcaggatgaacgctagctacaggcttaacacatgcaagtcgcggggcagcatgttgtgtgcttgcacacaatgatggcgaccggcgcacgggtgcgtaacgcgtatccaacctgccccttactctggaatagcccggcgaaagtcggattaatgccggatgttgtcagatgaggacatctgagtttgaccaaaggcttctgccggtaag

SEQ ID NO: 182 - DNA, 225 bp, Unknown
  Encodes 16S rRNA from Anaerovorax
agagtttgatcctggctcaggatgaacgctggcggcgtgcctaacacatgcaagtcgagcgagaaacctttgattgacgcttcggttgatttcaaaggcggaaagcggcggacgggtgagtaacgcgtaggcaacctgccccttgcagagggatagcctcgggaaaccgggattaaaacctcataatgctgatcctacacatgtttgatcagccaaagatttatc

SEQ ID NO: 183 - DNA, 225 bp, Unknown
  Encodes 16S rRNA from Prevotella
agagtttgatcctggctcaggatgaacgctagctacaggcttaacacatgcaagtcgaggggcagcatgaatcaagcttgcttgatttgatggcgaccggcgcacgggtgcgtaacgcgtgtccaacctacccaccgctcagggatagcccatcgaaagatgaattaatacctgatgttgtatgggaatcacatggcttccatactaaagatttatcggcgatgg

SEQ ID NO: 184 - DNA, 225 bp, Unknown
  Encodes 16S rRNA from Methanobrevibacter
agagtttgatcatggcagaagctactgctattgggattcgattaagccatgcaagtcgaacgaatttagattcgtggcgtacggctcagtaacacgtggataacctacccttaggaccgggataaccctgggaaactggggctaatactggatagatgatttttcctggaatggttttttgtttaaatgttttttcgcctaaggatgggtctgcggcagattagg

SEQ ID NO: 185 - DNA, 225 bp, Unknown
  Encodes 16S rRNA from Corynebacterium
agagtttgatcatggctcaggacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggaccatcgtttagtgtcggtggtggaaagtttttcggtgcaggatgagctcgcgg

SEQ ID NO: 186 - DNA, 225 bp, Unknown
  Encodes 16S rRNA from Clostridium XlVa
agagtttgatcatggctcaggatgaacgctggcggcgcgcctaacacatgcaagtcgaacggagcatcattaatgagactttcgggtggatttgatgatgacttagtggcggacgggtgagtaacgcgtggggaacctgccctgtacagggggacaacagccggaaacagctgctaataccgcataagcgcacagtgccgcatggtacagtgtgaaaagccgaga

SEQ ID NO: 187 - DNA, 166 bp, Unknown
  Encodes 16S rRNA from Alkaliphilus
agagtttgatcatggctcaggatgaacgctggcggcgtgcctaacacatgcaagtcgagcgagaatcagggaaatgaagcttcggtagattggaactgaggacagcggcggacgggtgagtaacgcgtgggcaacctgccccttactggtggatagccgcggtaat

SEQ ID NO: 188 - DNA, 225 bp, Unknown
  Encodes 16S rRNA from Ruminococcus
agagtttgatcatggctcaggacgaacgctggcggcacgcctaacacatgcaagtcgaacggacgagaaggagcttgcttcttcaagttagtggcggacgggtgagtaacacgtgagcaacctgcctttaagagagggatagcttctggaaacggatggtaatacctcataacacatcgggaccgcatgattctgatgtcaaagatttatcgcttaaagatgggc

SEQ ID NO: 189 - DNA, 225 bp, Unknown
  Encodes 16S rRNA from Clostridium XlVa
agagtttgatcatggctcaggatgaacgctggcggcgtgcttaacacatgcaagtcgaacggaacttattgaatgaagttttcggatggattttgataagtttagtggcggacgggtgagtaacgcgtgggtaacctgccctgtacagggggataacagttagaaatgactgttaataccgcataagaccacagtgccgcatggcacaggggtaaaagctgcgac

SEQ ID NO: 190 - DNA, 225 bp, Unknown
  Encodes 16S rRNA from Eubacterium
agagtttgatcatggctcaggatgaacgctggcggcgtgcctaacacatgcaagtcgagcgagaagagaatgacctattcttcggatgaagccattctcggacagcggcggacgggtgagtaacacgtaggaaacctgccctttactgggggatagccgagggaaacttcgagtaataccccataacgcgttatgatcgcatgatcgaaacgccaaagatttatc

SEQ ID NO: 191 - DNA, 225 bp, Unknown
  Encodes 16S rRNA from Bacteroides
agagtttgatcctggctcaggatgaacgctagctacaggcttaacacatgcaagtcgaggggcagcatgaacttagcttgctaagtttgatggcgaccggcgcacgggtgagtaacacgtatccaacctgcccatgactcagggatagccctctgaaaggaggattaatacctgatgcggttgactggggacatcccctttcaaccaaagattcatcggtcatgg

SEQ ID NO: 192 - DNA, 225 bp, Unknown
  Encodes 16S rRNA from Roseburia
agagtttgatcctggctcaggatgaacgctggcggcgtgcctaacacatgcaagtcgaacggacccatggaaaagattagcttgctatgattttccggaaggttagtggcggacgggtgagtaacgcgtgggtaacctgcctcatacagggggatagcagttggaaacgactggtaataccgcataagcgcacagtaccgcatggtacagtgtgaaaaactccgg

SEQ ID NO: 193 - DNA, 225 bp, Unknown
  Encodes 16S rRNA from Lentisphaera
agagtttgatcctggctcagaatgaacgctggcggcatggattaggcatgcaagtcgaacgagaaagcccgcaagggcgagtaaagtggcgaaagggtgagtaacacgtgagcaacctgcccccgagaccggaacaagcctgggaaaccgggtctgaaaccggatgaggaccgggaaggcatcttcccgcctccaaacattcatggctcggggatgggctcgcgg

SEQ ID NO: 194 - DNA, 225 bp, Unknown
  Encodes 16S rRNA from Eubacterium
agagtttgatcctggctcaggattaacgctggcggcgtgcctaacacatgcaagtcgagcgagaattaaatgaatgattcttcggatgaattcgtttaaggacagcggcggacgggtgagtaacgcgtgggcaacctgcccctttccggaggatagccaagggaaactttgaataatactccataaagcatttttgccgcatgacagagatgccaaagatttatc

SEQ ID NO: 195 - DNA, 225 bp, Unknown
  Encodes 16S rRNA from Roseburia
agagtttgatcatggctcaggatgaacgctggcggcgtgcctaacacatgcaagtcgagcggaccttagagagtgaacagcttgctgggatctttcgaaaggttagcggcggacgggtgagtaacgcgtgggtaacctgcctcatacagggggatagcagttggaaacgactggtaataccgcataagcgcacagtaccgcatggtacggtgtgaaaaactccgg

SEQ ID NO: 196 - DNA, 225 bp, Unknown
  Encodes 16S rRNA from Clostridium IV
agagtttgatcatggctcaggatgaacgctggcggcatgcctaacacatgcaagtcgaacggagttattagacggaagccttcgggtggaagattaataacttagtggcggacgggtgagtaacgcgtgagtaacctgcctctcagagggggataacgttctgaaaagaacgctaataccgcatataatcaagaaaccgcatgattttttgatgaaaggagcaat

SEQ ID NO: 197 - DNA, 215 bp, Unknown
  Encodes 16S rRNA from Hahella
agagtttgatcatggctcaggatgaacgctagctacaggcttaacacatgcaagtcgaggggaaaccctgatgcagccatgccgcgtgtgtgaagaaggccttcgggttgtaaagcacttttgcattcgaggaagacagcgtataaataaatgcgctatttgacgttagagtgtgaataagcaccggcaaactccgtgccagcagccgcggtaat

SEQ ID NO: 198 - DNA, 225 bp, Unknown
  Encodes 16S rRNA from Butyricicoccus
agagtttgatcatggctcaggataaacgctggcggcgtgcataacacattcaagtcgaacggacgatacgagaaacttcggttttttgtaaagttagtggcggacgggtgagtaacgcgtgagcaatctgcctttgatagagggataacacatggaaacgtgtgctaataccgcataacgttaaagaaccgcatgattctttaaccaaagctccggcgatcaaag

SEQ ID NO: 199 - DNA, 225 bp, Unknown
  Encodes 16S rRNA from Clostridium IV
agagtttgatcatggctcaggacgaacgctggcggcgtgcctaacacatgcaagtcgagcggacttgtatttggaaagtgcttgcaccggaagaatacaagttagcggcggacgggtgagtaacgcgtgagcaacctgtcctctacagggggataagatctcgaaagggattctaataccgcatgagaccacagcagggcatcctgcgggggtcaaaggaggaat

SEQ ID NO: 200 - DNA, 225 bp, Unknown
  Encodes 16S rRNA from Prevotella
agagtttgatcatggctcaggatgaacgctagctacaggcttaacacatgcaagtcgcggggcagcatgggagttgcttgcaatttccgatggcgaccggcgcacgggtgcgtaacgcgtatccaacctacccgcaagtcagggccagcccggcgaaagtcggattaatccctgatgtggtgcgaagaggacatctgattcacattaaaggagcgatttgcttgc

SEQ ID NO: 201 - DNA, 225 bp, Unknown
  Encodes 16S rRNA from Clostridium IV
agagtttgatcatggcttaggatgaacgctggcggcgtgcataacacattcaagtcgaacggtgaagggacttcggtcccggatcagtggcggacgggtgagtaacgcgtgagcaacctgccctgcagtgcgggataacagagggaaacttctgctaataccgcatatagcatcggaaccgcatgattccggtatgaaagatttattgctgcaggatgggctcgc

SEQ ID NO: 202 - DNA, 225 bp, Unknown
  Encodes 16S rRNA from Desulfovibrio
agagtttgatcctggctcagattgaacgctggcggcgtgcttaacacatgcaagtcgaacgcgaaaggggcttcggccccgagtagagtggcgcacgggtgagtaacgcgtggataatctgcccctgcaactggaatagcgactggaaacggtcgataataccggatacgcccttgtcttacaatgaggggaaaggagacctctgcttgcaagtttccgtgcagg

SEQ ID NO: 203 - DNA, 225 bp, Unknown
  Encodes 16S rRNA from Sphingobacterium
agagtttgatcatggctcaggatgaacgctagcggcaggcctaatacatgcaagtcgaacgggatctatgagtaagcttgcttacttttagtgagagtggcgcacgggtgcgtaacgcgtgagcaacctacccatatcagggggatagcccggagaaatccggattaacaccgcatgacacagcaattcggcatcgaatcactgttaaatatttataggatatgg

SEQ ID NO: 204 - DNA, 225 bp, Unknown
  Encodes 16S rRNA from Roseburia
agagtttgatcctggctcaggatgaacgctggcggcgtgcctaacacatgcaagtcgagcggacctgattaagtgaatagcttgctatgaacttatgactggttagcggcggacgggtgagtaacgcgtgggtaacctgcctcatacagggggatagcagttggaaacgactggtaataccgcataagcgcacagtaccgcatggtacagtgtgaaaaactccgg

SEQ ID NO: 205 - DNA, 225 bp, Unknown
  Encodes 16S rRNA from Bacteroides
agagtttgatcctggctcaggatgaacgctagcgacaggcctaacacatgcaagtcgaggggcagcatgagagtagcaatacttttgatggcgaccggcgcacgggtgcgtaacaggtgtgcaatctgtccataatcggggaatagcccgccgaaaggtgaattaacgctccatgtgtaatgaagaggcatctctttattatgaaacgtaaggattatgggtgag

SEQ ID NO: 206 - DNA, 225 bp, Unknown
  Encodes 16S rRNA from Ruminococcus
agagtttgatcatggctcaggacgaacgctggcggcacgcctaacacatgcaagtcgaacggtgtttatcagcttgctggtaaacatagtggcggacgggtgagtaacacgtgagcaacctgccttcaagagagggatagcttctggaaacggatggtaataccttataatatatactggccgcatgaccggtatatcaaacgaattttgcttgaagatgggctc

SEQ ID NO: 207 - DNA, 225 bp, Unknown
  Encodes 16S rRNA from Prevotella
agagtttgatcatggctcaggatgaacgctagcggcaggcttaacacatgcaagtcgaggggcatcgggtccagcaatggatgccggcgaccggcgaaagggtgagtaacgcgtgagcaacgtgcccgtctgagggggatagtcattggaaacgatgcgtaataccccgtaacaacagtcaccgcatggtgggtgtttgaaagatttattgcagacggatcggct

SEQ ID NO: 208 - DNA, 225 bp, Unknown
  Encodes 16S rRNA from Asteroleplasma
agagtttgatcctggctcaggataaacgccggcggcgtgcctaatacatgcaagtcgaacgaggctcttcggagccgagtggcgtacgggtgagtaacacgttggtaacctgccctccagaccggaataccagagagaaatctctgctaatgccggatgacgtcatatggtcgcaagaccacttgaccaaaggcggcaactgccgcgctgaaggatggacctgcg

SEQ ID NO: 209 - DNA, 225 bp, Unknown
  Encodes 16S rRNA from Syntrophococcus
agagtttgatcatggctcaggatgaacgctggcggcgtgcctaacacatgcaagtcgagcggacttatgatgagattcttcggatgatttttataagttagcggcggatgggtgaggaacgcgtggagaacctgcccttcacagggggataacagttggaaacgactgttaataccgcatatgctcacgcgaccgcatggtcgagtgaggaaagctccggcggtg

SEQ ID NO: 210 - DNA, 225 bp, Unknown
  Encodes 16S rRNA from Victivallis
agagtttgatcatggctcagaatgaacgctggcggcatggattaggcatgcaagtcgaacgccccggtccctcgggtccggggagtggcgaaagggtgcgcaacgcgtggggaacccgcccccgggcccgggacaagcgctggaaacggcgtctaataccggatggaggggccgccggcatcggcggctgccgaaagtcttctcgcccggggagggccccgcgtc

SEQ ID NO: 211 - DNA, 225 bp, Unknown
  Encodes 16S rRNA from Lachnobacterium
agagtttgatcctggctcaggatgaacgctggcggcgtgcttaacacatgcaagtcgaacgaagcacctggtcacgatcccttcggggtgacgaccttgtgactgagtggcggacgggtgagtaacgcgtgggaaacctgccatgtactgggggataacagttggaaacggctgctaataccgcataacactgttggatcgcatgatccgatagccaaaactccg

SEQ ID NO: 212 - DNA, 225 bp, Unknown
  Encodes 16S rRNA from Lachnospiracea incertae sedis
agagtttgatcatggctcaggatgaacgctggcggcgtgcttaacacatgcaagtcgaacgaagctcttacgacagatctcttcggagtgaagatgtttgagactgagtggcggacgggtgagtaacgcgtgggtaacctgcctcatagagggggacaacagttggaaacgactgctaataccgcatagtaagaaagaaccgcatgattttttcttgaaagcttt

SEQ ID NO: 213 - DNA, 225 bp, Unknown
  Encodes 16S rRNA from Clostridium IV
agagtttgatcatggctcaggatgaacgctggcggcgtgcataacacattcaagtcgaacggacgccttcgggcgccagtggcggacgggtgagtaacgcgtgaggaacctgccgcggattggggaataacgaccggaaacagtcgctaataccgcataacgcacagaggccgcatgacctttgtgccaaagatttatcgatccgcgatggactcgcgtccaatt

SEQ ID NO: 214 - DNA, 225 bp, Unknown
  Encodes 16S rRNA from Anaerorhabdus
agagtttgatcctggctcaggataaacgctggcggcgtgcctaatacatgcaagtcggacgaggattgagacttcggttttaatccgagtggcgaacgggtgagtaaaacgtaagcaacctgcctacaaggaccgggataacacctggaaacgggcgctaaaaccggataggcaataagggggcatcctcatattgttaaaggtgagaaacacaagtagatgggc

SEQ ID NO: 215 - DNA, 225 bp, Unknown
  Encodes 16S rRNA from Altererythrobacter
agagtttgatcatggctcagaacgaacgctggcggcatgcttaacacatgcaagtcgaacggtgttttctagtacttgtattaggaaacatagtggcaaacgggtgagtaacgcgtgggaatgtaccctttggtattgaataacgtctggaaacggacgctaatacaatataagctcgagagaggaaagagaaatcgctgaaggagtagcccgcgttagattagg

SEQ ID NO: 216 - DNA, 225 bp, Unknown
  Encodes 16S rRNA from Clostridium XlVa
agagtttgatcatggctcaggatgaacgctggcggcgtgcctaacacatgcaagtcgaacggagaaagatgcttcggtatctttcttagtggcggacgggtgagtaacgcgtgggtaacctgccccatacaggggaacaacagctggaaacggctgctaataccgcataagcgcacggtaccgcatggtacagtgtgaaaagattgtatcggtatgggatggacc

SEQ ID NO: 217 - DNA, 225 bp, Unknown
  Encodes 16S rRNA from Clostridium XlVa
agagtttgatcctggctcaggatgaacgctggcggcgtgcctaacacatgcaagtcgaacggaacttttattaatggagattcgtcaaagttgatttaagtttagtggcggacgggtgagtaacgcgtgggtaacctgcctcatagagggggataacggctggaaacgaccgctaataccgcataagcccacagtaccgcatggtacagggggaaaagatttatc

SEQ ID NO: 218 - DNA, 225 bp, Unknown
  Encodes 16S rRNA from Proteiniclasticum
agagtttgatcatggctcaggacgaacgctggcggtatgcctaacacatgcaagtcgaacgaaaaacgagggcttgctctcgtttttagtggcgcacgggtgagtaacgcgtgagtaatctgccttaaagtgggggacaacatttggaaacgaatgctaataccgcgtaatatacagttttcgcatggattttgtattatagatttatcgctttaagatgagctc

SEQ ID NO: 219 - DNA, 225 bp, Unknown
  Encodes 16S rRNA from Bifidobacterium
agagtttgatcctggctcaggacgaacgctggcggcgtgcttaacacatgcaagtcgaacgggatcctgcaagcttgcttgcgggtgagagtggcgaacgggtgagtaatgcgtgaccaacctgccccattctccggaatagctcctggaaacgggtggtaatgccggatgctccgccccctcgcatggggggtcgggaaggcttttgcggaatgggatggggtc

SEQ ID NO: 220 - DNA, 225 bp, Unknown
  Encodes 16S rRNA from Clostridium XlVa
agagtttgatcctggctcaggatgaacgctggcggcgtgcctaacacatgcaagtcgagcggagtgaatcgagtgcttgcacatgattcacttagcggcggatgggtgaggaacgcgtggagaacctgcctcacacagggggataacagttggaaacgactgttaataccgcatatgctcacggtaccgcatggtacagggaggaaagatttatcggtgtgagat

SEQ ID NO: 221 - DNA, 225 bp, Unknown
  Encodes 16S rRNA from Clostridium XlVa
agagtttgatcctggctcaggatgaacgctggcggcgtgcctaacacatgcaagtcgaacgaagttgtttccacccgacagattatcttcggatatgaagtcaccggaaacgcttagtggcggacgggtgagtaacgcgtgggcaacctgccctacacagggggatagcggttggaaacgaccggtaataccgcatacctttattttgccgcatgacagaataaa

SEQ ID NO: 222 - DNA, 225 bp, Unknown
  Encodes 16S rRNA from Desulfovibrio
agagtttgatcatggctcaggacaaacgctggcggcgtgcctaacacatgcaagtcgaacgagcccttcggggctagtggcagacgggtgagtaacgcgtaggtaatgtacctcttcgctggggataccgttccgaaaggaacgttaataccgaatgaattcatcgggcggcatcgcttgatgaataaaccgcaagggcgaggagatcagcttgcgtactatcag

SEQ ID NO: 223 - DNA, 225 bp, Unknown
  Encodes 16S rRNA from Clostridium XlVa
agagtttgatcatggctcaggatgaacgctggcggcgtgcctaacacatgcaagtcgaacggcggatgcatttcggtgtatctgcagtggcggacgggtgagtaacgcgtgggtaatctgccctgtacaggggaatagcagttggaaacgactgataaaaccgcataagcacacaggaccgcatggtcccgggtgaaaaactccggtggtacaggatgagcccgc

SEQ ID NO: 224 - DNA, 225 bp, Unknown
  Encodes 16S rRNA from Nitrobacter
agagtttgatcatggctcagagcgaacgctagcggaatgctttatacatgcaagtcgaacgaatgagtttatattgagtagcaatacgatttataaatgagttagtggcgaacgggtgagtaatagataggaacttgccgagtagtgggggacaacagatagaaatgtctgctaataccgcatacgcccgagaggggaaagatttatcgctatttgagaggccta

SEQ ID NO: 225 - DNA, 225 bp, Unknown
  Encodes 16S rRNA from Enterorhabdus
agagtttgatcctggctcaggatgaacgctggcggcgtgcttaacacatgcaagtcgaacggttaaaccggcttcggccggacatacagtggcgaacgggtgagtaacacgtgaccaacctgccccgcgctccgggacagccccccgaaagggggattaataccgggtactccgggaggggcgcatgccccgcccgggaaagcccaggcggcgcgggatggggtc

SEQ ID NO: 226 - DNA, 225 bp, Unknown
  Encodes 16S rRNA from Clostridium sensu stricto
agagtttgatcctggctcaggacgaacgctggcggcgtgcttaacacatgcaagtcgagcggggataatgagacggaaggcttcggccggaagacttattattctagcggcggacgggtgagtaacgcgtgaatgatctgtctcttacagggggataacacttggaaacaggtgctaataccgcataagaccacggggctgcatggccttgaggtaaaaggagcg

SEQ ID NO: 227 - DNA, 225 bp, Unknown
  Encodes 16S rRNA from Oscillibacter
agagtttgatcctggctcaggacgaacgctggcggcgtgcctaacacatgcaagtcgaacgggacttattggaatgagacttcggtcaaaggaaaataagtttagtggcggacgggtgagtaacgcgtgagcaacctgcctttcagagggggacaacagttggaaacgactgctaataccgcataacgtacagaggaggcatcttccctgtaccaaagatttatc

SEQ ID NO: 228 - DNA, 225 bp, Unknown
  Encodes 16S rRNA from Nautilia
agagtttgatcatggctcagagttaacgctggcggcgtgcctaacacatgcaagtcgagcgaattcttacagagtatcgtaagagttagcggcaaacgggtgagtaacacatgggaaacctcccttagaatggggaatatctccgtgaaaacggagctaataccgcataagaccacagtttggcatcaaacaggggtaaaagcagcaatgcgttctaagatggtc

SEQ ID NO: 229 - DNA, 225 bp, Unknown
  Encodes 16S rRNA from Corynebacterium
agagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggaccatcgtttagtgtcggtggtggaaagtttttcggtgcaggatgagctcgcgg

SEQ ID NO: 230 - DNA, 225 bp, Unknown
  Encodes 16S rRNA from Ruminococcus
agagtttgatcatggctcaggacgaacgctggcggcacgcctaacacatgcaagtcgagcggtgaattttggatttattcgagattcatagcggcggacgggtgagtaacacgtgagcaacctacctctaagtgagggatagcttctggaaacggatggtaataccttataatatatatttatcacatgatagatatatcaaagatttattgcttagagatgggc

SEQ ID NO: 231 - DNA, 225 bp, Unknown
  Encodes 16S rRNA from Coprococcus
agagtttgatcctggctcaggatgaacgctggcggcgtgcctaacacatgcaagtcgaacgaagtgtcatttcttcggaggtaacacttagtggcggacgggtgagtaacgcgtgggtaacctgcctcatacagggggatagcagttggaaacgactgataataccgcataagcgcacagcatcgcatggtgcagtgtgaaaaactccggtggtatgagatggac

SEQ ID NO: 232 - DNA, 225 bp, Unknown
  Encodes 16S rRNA from Eubacterium
agagtttgatcatggctcaggattaacgctggcggcgtgcctaacacatgcaagtcgagcgagaaatagtgaagagattcttcggatgaacagatctatggacagcggcggacgggtgagtaacgcgtgggcaacctgcccctttccggaggatagccaagggaaactttgaataatactccataaagcagagatgtcgcatggcaattctgccaaagatttatc

SEQ ID NO: 233 - DNA, 225 bp, Unknown
  Encodes 16S rRNA from Rikenella
agagtttgatcctggctcaggatgaacgctagcggcaggcttaacacatgcaagtcgaggggcagcgagttgtagcaatacaatgtcggcgaccggcggaagggtgcgtaacgcgtgagcaacatgcccgtatctgggggataggagatggaaacgtcttataataccccataacaacagaggctgcatggcctttgtttgaaagattcattggatacggattgg

SEQ ID NO: 234 - DNA, 225 bp, Unknown
  Encodes 16S rRNA from Clostridium XlVa
agagtttgatcctggctcaggatgaacgctggcggcgtgcctaacacatgcaagtcgagcggacttaagaaaagaatcttcggatgaaatttttaagttagcggcggatgggtgaggaacgcgtggagaacctgcccttcacagggggataacagctggaaacggctgttaataccgcatatgctcacggagccgcatggccccgggaggaaagctccggcggtg

SEQ ID NO: 235 - DNA, 225 bp, Unknown
  Encodes 16S rRNA from Paenibacillus
agagtttgatcatggctcaggatgaacgctggcggcgtgcttaatacatgcaagtcgaacggatgagttttctagcttgctagaagatgattcagtggcgaacgggtgagtaatacgtaggcaacctgccccaaagcgggggatagcagttggaaacgactattaataccgcataggtaatcttaaggcatcttgagattattaaaggtgcgtttgcaccgctgt

SEQ ID NO: 236 - DNA, 225 bp, Unknown
  Encodes 16S rRNA from Ruminococcus
agagtttgatcatggctcaggacgaacgctggcggcacgcctaacacatgcaagtcgaacggtagatacttagcttgctttgtatctatagtggcggacgggtgagtaacacgtgagcaacctgcctctgagagagggatagcttctggaaacggatggtaatacctcatgacatagtgtcttcgcatggagatgctatcaaacgaatctcgctcagagatgggc

SEQ ID NO: 237 - DNA, 225 bp, Unknown
  Encodes 16S rRNA from Prevotella
agagtttgatcctggctcaggatgaacgctagctacaggcttaacacatgcaagtcgaggggcagcatggggatggcttgccattcccgatggcgaccggcgcacgggtgagtaacgcgtatccaacctgcccgcaaccgcggaatagcccgccgaaaggcggattaatgccgcatgagctcgcgtgaggacatctgcccgcgagcaaaggttcgttccggttgc

SEQ ID NO: 238 - DNA, 225 bp, Unknown
  Encodes 16S rRNA from Haematobacter
agagtttgatcatggctcagaacgaacgctggcggcaggcctaacacatgcaagtcgagcgagatcttcggatctagcggcggacgggtgagtaacgcgtgggaacgtaccctttgcttcggaatagcctcgggaaactgggagtaataccgaatgtgccctacgggggaaagatttatcggcaaaggatcggcccgcgttggattaggtagttggtgaggtaat

SEQ ID NO: 239 - DNA, 225 bp, Unknown
  Encodes 16S rRNA from Prevotella
agagtttgatcctggctcaggatgaacgctagctacaggcttaacacatgcaagtcgaggggcatcatgggggttgtttacaatccctgatggcgaccggcgcacgggtgagtaacgcgtatccaacctgccttcgagtcagggataaccttccgaaagggagcctaatacctgatgcagtgcgatgatggcatcagaattgcactaaagctttagcgctcggag

SEQ ID NO: 240 - DNA, 225 bp, Unknown
  Encodes 16S rRNA from Clostridium XlVa
agagtttgatcctggctcaggatgaacgctggcggcgtgcctaacacatgcaagtcgaacggagatatcacggatgaaggattcgtctgaattctgttttatcttagtggcggacgggtgagtaacgcgtggagaacctgcctctttccgggggatagcagttggaaacgactggtaataccgcatgagcgcacagtaccgcatggtacggggtgaaaagattta

SEQ ID NO: 241 - DNA, 225 bp, Unknown
  Encodes 16S rRNA from Lachnospiracea incertae sedis
agagtttgatcctggctcaggatgaacgctggcggcgtgcttaacacatgcaagtcgagcgaagcgctttggaagattccttcgggatgaatcctttgtgacttagcggcggacgggtgagtaacgcgtgggcaacctgccttgtacagggggataacagttagaaatgactgctaataccgcataagcgcacagcatggcatcatgcagtgcgaaaaactccgg

SEQ ID NO: 242 - DNA, 164 bp, Unknown
  Encodes 16S rRNA from Enterorhabdus
agagtttgatcatggctcaggatgaacgctggcggcgtgcctaacacatgcaagtcgaacgaagcacttttgcattcgaggaagacagcacgtaaataaacgtgttatttgacgttagagtgtgaataagcaccggcaaactccgtgccagcagccgcggtaat

SEQ ID NO: 243 - DNA, 225 bp, Unknown
  Encodes 16S rRNA from Blautia
agagtttgatcatggctcaggatgaacgctggcggcgtgcctaacacatgcaagtcgaacggagattcattggaaataagcttcggcagaaataagatggatcttagtggcggacgggtgagtaacgcgtggagaacctgccctgtacagggggataacatccagaaatggatgctaaaaccgcataagcgcacatgaccgcatggtcaagtgtgaaaaactccg

SEQ ID NO: 244 - DNA, 225 bp, Unknown
  Encodes 16S rRNA from Sporobacter
agagtttgatcatggctcaggatgaacgctggcggcgtgcctaacacattcaagtcgaacggagaagggacttcggtcccggatcagtggcggacgggtgagtaacgcgtgagcaacctgcctttgcccgggggataacagccggaaacagctgctaataccgcataacgtacggacgccgcatgacgaccgtaccaaagatttattgggcaaagatgggctcgc

SEQ ID NO: 245 - DNA, 225 bp, Unknown
  Encodes 16S rRNA from Oscillibacter
agagtttgatcatggctcaggacgaacgctggcggcgtgcctaacacatgcaagtcgaacgggacttaatggaatgagacttcggtcaaaggaagttaagtttagtggcggacgggtgagtaacgcgtgagcaacctgcctttcagagggggacaacagttggaaacgactgctaataccgcataacgtacggaggaggcatctttttcgtaccaaagatttatc

SEQ ID NO: 246 - DNA, 225 bp, Unknown
  Encodes 16S rRNA from Clostridium XlVa
agagtttgatcctggctcaggatgaacgctggcggcgtgcctaacacatgcaagtcgaacggggatagagagaagttttcggacagacctttatcttagtggcggacgggtgagtaacgcgtggataacctgcctttttctgggggatagcagttggaaacgactgataataccgcataagctccgattcccgcatgggagccggaggaaagatttatcgggaga

SEQ ID NO: 247 - DNA, 225 bp, Unknown
  Encodes 16S rRNA from Atopobium
agagtttgatcatggctcaggatgaacgctggcggcgcgcctaacacatgcaagtcgaacggttaaagccccttcgggggtgtataaagtggcgaacggctgagtaacacgtgggcaacctacctcttgctctgggatagcctcgagaaatcgtgggtaataccggatactccgtaaccgtcgcatggcggatacgggaaagcgcatacggcaagagatgggccc

SEQ ID NO: 248 - DNA, 225 bp, Unknown
  Encodes 16S rRNA from Sporobacter
agagtttgatcatggcttaggatgaacgctggcggcgtgcataacacattcaagtcgaacgatgaacggacttcggtccgggattagtggcggacgggtgagtaacgcgtgagcaacctgccccggagtgagggataacagacggaaacatctgctaatacctcatatagcatcgggttcgcatgtacctggtatgaaaggtttactgctccgggatgggctcgc

SEQ ID NO: 249 - DNA, 225 bp, Unknown
  Encodes 16S rRNA from Clostridium XlVa
agagtttgatcctggctcaggatgaacgctggcggcgtgcctaacacatgcaagtcgaacggggtgtccgatcttcggactggacacttagtggcggacgggtgagtaacgcgtgggtaacctgcctcatacagggggatagcagttggaaacgactgataataccgcataagcgcacagcatcgcatgatgcagtgtgaaaaactccggtggtatgagatggac

SEQ ID NO: 250 - DNA, 225 bp, Unknown
  Encodes 16S rRNA from unknown taxa
agagtttgatcatggctcaggatgaacgctggcggcgtgtttaaggcatgcaagtcgaatgggtttagacccatggcaaacgggagagtaatactttggtaatttaccccttagtcgtgaataactattcgaaagattagataatacacgatggtctcaaagaactcgagttttttgagtaaagatttatcgctaagggagaagcctaaggactatcagctagtt

SEQ ID NO: 251 - DNA, 225 bp, Unknown
  Encodes 16S rRNA from Oscillibacter
agagtttgatcatggctcaggatgaacgctggcggcgtgcctaacacatgcaagtcgaacggagcttaatggaaggagacttcggtcaacggaagataagcttagtggcggacgggtgagtaacgcgtgagcaacctgcctcagagtgggggacaacagctggaaacggctgctaataccgcataaaattgttagaaggcatcttctgataatcaaagcttaatg

SEQ ID NO: 252 - DNA, 225 bp, Unknown
  Encodes 16S rRNA from Clostridium XlVa
agagtttgatcatggctcaggatgaacgctggcggcgtgcttaacacatgcaagtcgaacgaggtttaagacttcggttttaaaccgagtggcggacgggtgagtaacgcgtgggtaacctgccgtatgcagggggacaacagttagaaatgactgctaataccgcataagcttacagtatcgcatgatacagtgagaaaagatttatcggcatacgatggaccc

SEQ ID NO: 253 - DNA, 225 bp, Unknown
  Encodes 16S rRNA from Clostridium IV
agagtttgatcctggctcaggacgaacgctggcggtatgcttaatacatgcaagtcgaacggagcttagcggaagcttgcttctgcgaaagcttagtggcggacgggtgagtaacgcgtgagtaacctgccttaaagagggggataacacagagaaatttgtgctaataccgcataatgtagcgaagccgcatgactttgctaccaaaggtcagccgctttaaga

SEQ ID NO: 254 - DNA, 225 bp, Unknown
  Encodes 16S rRNA from Mogibacterium
agagtttgatcatggctcaggatgaacgctggcggcgtgcctaatacatgcaagtcgagcgagaatctcttcagaagcgttttcggacaattccgaggagaggaaagcggcggacgggtgagtaacgcgtaggcaacctgcccttagcagagggatagccattggaaacgatgattaaaacctcataatgccatctttacacatgtttagatggccaaagattta

SEQ ID NO: 255 - DNA, 225 bp, Unknown
  Encodes 16S rRNA from Roseburia
agagtttgatcatggctcaggatgaacgctggcggcgtgcttaacacatgcaagtcgaacgaatttttttctgaaggaagcttcggcagacggaaggaagaagtgagtggcggacgggtgagtaacgcgtgggtaacctgcctcacattgggggataccagtcggaaacgactgctaataccgcataagaccacggcaccgcatggtgctgtggccaaaactccg

SEQ ID NO: 256 - DNA, 225 bp, Unknown
  Encodes 16S rRNA from Lachnospiracea incertae sedis
agagtttgatcctggctcaggatgaacgctggcggcgtgcttaacacatgcaagtcgagcgaagcgctctggaagattcctttgggatgattccttagtgacttagcggcggacgggtgagtaacgcgtgggcaacctgccttgtacagggggataacagttagaaatgactgctaataccgcataagcgcacagcatggcatcatgcagtgtgaaaaactccgg

SEQ ID NO: 257 - DNA, 225 bp, Unknown
  Encodes 16S rRNA from Pelotomaculum
agagtttgatcatggctcaggacgaacgctggcggcgtgcctaacacatgcaagtcgaacggagattaagatttcggttttaatctgagtggcgaacgggtgagtaacgcgtgagcaacctgcccttcagagggggataaccgctggaaacagcagctaataccgcataagaccacagcccggcatcggggaggggtcaaaggagcaatccgctgaaggaggggc

SEQ ID NO: 258 - DNA, 225 bp, Unknown
  Encodes 16S rRNA from Pelotomaculum
agagtttgatcctggctcaggacgaacgctggcggcgtgcctaacacatgcaagtcgaacggagcaggggacttcggttctctgctgagtggcgaacgggtgagtaacgcgtgagcaacctgaccttgagagggggataacgacgggaaactgtcgctaataccgcatgagaccacagcccggcatcggggaggggtcaaaggagaaatccgctgaaggaggggc

SEQ ID NO: 259 - DNA, 225 bp, Unknown
  Encodes 16S rRNA from Clostridium XlVa
agagtttgatcatggctcaggatgaacgctggcggcgtgcctaacacatgcaagtcgaacggagctgcgacgctgaggagtggagtacttgtacaaagcgaatcttgtcgtagcttagtggcggacgggtgagtaacgtgtggataacctggtccatccagggggatagcagctggaaacggctggtaataccgcataagcgcacagagaggcatctctcggtgt

SEQ ID NO: 260 - DNA, 225 bp, Unknown
  Encodes 16S rRNA from Robinsoniella
agagtttgatcctggctcaggatgaacgctggcggcacgcttaacacatgcaagtcgaacgagggaaaaggagcttgctcctttgacctagtggcggacgggtgcgtaacgcgtgggtaatctgccctgcacagggggataacgtatagaaatgtacgctaataccgcataagcccacagagtggcatcactcagggggaaaagcgaatacggtgcaggatgagc

SEQ ID NO: 261 - DNA, 225 bp, Unknown
  Encodes 16S rRNA from Coprococcus
agagtttgatcatggctcaggataaacgctggcggcgtgcttaacacatgcaagtcgaacggactgattaggtagcttgctacttatgaaagttagtggcggacgggtgagtaacgcgtgggtaacctgcctcacacagggggataacagttggaaacgactgttaataccgcataagcgcacaggatcgcatggtctagtgtgaaaaactccggtggtgtgaga

SEQ ID NO: 262 - DNA, 225 bp, Unknown
  Encodes 16S rRNA from Wautersiella
agagtttgatcctggctcaggatgaacgctagcgggaggcttaacacatgcaagccgaggggtatttgtggcttgctacaaagagaccggcgcacgggtgcgtaacgcgtatgcaacttgccctactgaaagggatagccttttgaaaagaagattaataccttataatagtgagactggcatcagtaacacttgaaagatttatcgcagtaggataggcatgcg

SEQ ID NO: 263 - DNA, 184 bp, Unknown
  Encodes 16S rRNA from Lachnospiracea incertae sedis
agagtttgatcatggctcaggatgaacgctggcggcgtgctttgcacaatgggggaaaccctgatgcagcgacgccgcgtgagtgatgaagtatttcggtacgtaaaactctatcagcagggaagaaaatgacggtacctgactaagaagcaccggctaaatacgtgccagcagccgcggtaat

SEQ ID NO: 264 - DNA, 225 bp, Unknown
  Encodes 16S rRNA from Planctomyces
agagtttgatcctggctcagaatgaacgttggcggcatggattaggcatgcaagtcgtacggtgaaggggagcttgctcctccgatcagtggcgaaagggatagtaacgcgtagacacctaccttctggacggggatagctgcgggaaactgcaggtaatacccgataatgacgagagtccaaaggtgtaattccttcagaagacggatctgcgtcctaccagat

SEQ ID NO: 265 - DNA, 225 bp, Unknown
  Encodes 16S rRNA from Treponema
agagtttgatcctggctcagaacgaacgctggcggcgcgtcttaagcatgcaagtcgagcgggaataagggagcttgcttccttatgagagcggcggactggtgagtaacacgtgggtaacgcaccctcctgacggggacagcctgtggaaacacagggtaataccggatgagatggacttctggaagggagttcatgaaaggagctacggctccgcagggggaa

SEQ ID NO: 266 - DNA, 225 bp, Unknown
  Encodes 16S rRNA from Coprococcus
agagtttgatcatggctcaggatgaacgctggcggcgtgcctaacacatgcaagtcgaacgagagagattggtgcttgcaccgatcaatcgagtggcggacgggtgagtaacgcgtgggtaacctgcctcatacagggggataacaactggaaacggttgataataccgcataagcgcacggtatcgcatgatacagtgtgaaaaactccggtggtatgagatgg

SEQ ID NO: 267 - DNA, 225 bp, Unknown
  Encodes 16S rRNA from Paracoccus
agagtttgatcctggctcagaacgaacgctggcggcaggcctaacacatgcaagtcgagcgaacccttcggggttagcggcggacgggtgagtaacgcgtgggaacgtgccctttgctacggaatagccccgggaaactgggagtaataccgtatacgcccttagggggaaagatttatcggcaagggatcggcccgcgttggattaggtagttggtggggtaat

SEQ ID NO: 268 - DNA, 225 bp, Unknown
  Encodes 16S rRNA from Ruminococcus
agagtttgatcatggctcaggacgaacgctggcggcacgcctaacacatgcaagtcgaacggtgaatgatcagtttactgaacattcatagtggcggacgggtgagtaacacgtgagcaacctgcctctgagagagggatagcttctggaaacggatggtaatacctcatgatatagcgttctcgcatgggaatgctatcaaaagaaattcgctcagagatgggc

SEQ ID NO: 269 - DNA, 225 bp, Unknown
  Encodes 16S rRNA from Atopobium
agagtttgatcatggctcaggatgaacgctggcggcgcgcctaacacatgcaagtcgaacggttaaagccccttcgggggtgtataaagtggcgaacggctgagtaacacgtgggcaacctacctcttgctctgggatagcctcgggaaaccgtgggtaataccggatactctgtaactgtcgcatggcggatacaggaaagcgcatacggcaagagatgggccc

SEQ ID NO: 270 - DNA, 225 bp, Unknown
  Encodes 16S rRNA from Prevotella
agagtttgatcctggctcaggatgaacgctagctacaggcttaacacatgcaagtcgaggggcagcatggaggtagcttgctatctccgatggcgaccggcgcacgggtgagtaacgcgtatccaaccttccctgaggtaggggacagcccggtgaaaaccggattaataccctatgttgtcacgataaggcatctgagcgtgacgaaagattcatcgcctcagg

SEQ ID NO: 271 - DNA, 225 bp, Unknown
  Encodes 16S rRNA from Clostridium IV
agagtttgatcatggctcaggatgaacgctggcggcgtgcctaacacattcaagtcgaacggtgaagggacttcggtcccggatcagtggcggacgggtgagtaacgcgtgagcaacctaccttcttgtgggggataacacagggaaacttgtgctaataccgcataacgtatctgacccgcatggggcggataccaaagatttattgcagggagatgggctcgc

SEQ ID NO: 272 - DNA, 225 bp, Unknown
  Encodes 16S rRNA from Clostridium XlVa
agagtttgatcatggctcaggatgaacgctggcggcgtgcctaacacatgcaagtcgagcggagttacattagcttgcttttgtaacttagcggcggatgggtgaggaacgcgtggataacctgcctcacactgggggataacagctggaaacggctgttaataccgcatatgctcacagtaccgcatggtacagggaggaaagatttatcggtgtgagatggat

SEQ ID NO: 273 - DNA, 225 bp, Unknown
  Encodes 16S rRNA from Clostridium XlVa
agagtttgatcctggctcaggatgaacgctggcggcgtgcctaacacatgcaagtcgagcggaggatcacattggaagccttcgggtggaagaagtgaaacttagcggcggacgggtgagtaacgcgtgggtaacctggctcatacagggggataacagagagaaatttctgctaataccgcataagcgcacagcaccgcatggtgcagtgtgaaaaactccggt

SEQ ID NO: 274 - DNA, 225 bp, Unknown
  Encodes 16S rRNA from Clostridium XlVa
agagtttgatcatggctcaggatgaacgctggcggcgtgcttaacacatgcaagtcgaacgaagcatttcggaatgcggcttcggccaaatgaagaactgacttagtggcggacgggtgagtaacgcgtgggtaacctgccttgtactgggggataacagttagaaatgactgctaataccgcataagcccacggtttcgcatggaactgtgagaaaagatttat

SEQ ID NO: 275 - DNA, 225 bp, Unknown
  Encodes 16S rRNA from Prevotella
agagtttgatcctggctcaggatgaacgctagctacaggcttaacacatgcaagtcgaggggcatcgagaagaaagcttgctttctttgtcggcgaccggcgcacgggtgagtaacgcgtatccaacctaccctttacactgggatagcccgttgaaaagcggattaataccagatgcagtcctttgcggacatctaagtaggacgaaaggtttttccggtagag

SEQ ID NO: 276 - DNA, 225 bp, Unknown
  Encodes 16S rRNA from Dethiosulfovibrio
agagtttgatcatggctcaggatgaacgctggcggcgtgcataacacattcaagtcgaacgaagcgccgggacggaacccttcggggggaagacccgatgacttagtggcggacgggtgagtaacgcgtgagcaacctgcctgcgatagagggataacaccgggaaaccggtgctaataccacatgacgcagcggggtcacatggccctgttgttaaagatttat

SEQ ID NO: 277 - DNA, 225 bp, Unknown
  Encodes 16S rRNA from Clostridium XI
agagtttgatcctggctcaggacgaacgctggcggcgtgcttaacacatgcaagtcgaacgaagatacggagcggaacccttcggggggaagatctgtagactgagtggcggacgggtgagtaacgcgtgagcaacctgcctacaagagggggacaacagctggaaacggctgctaataccgcataagaccacgctatcgcatggtagaggggtcaaagatttat

SEQ ID NO: 278 - DNA, 225 bp, Unknown
  Encodes 16S rRNA from Clostridium IV
agagtttgatcatggctcaggacgaacgctggcggcgtgcttaacacatgcaagtcgaacgaagttccgttgaatgagatttcggtcaaaggagacggacacttagtggcggacgggtgagtaacgcgtgagtaacctgcctttcagaggggaataacatttggaaacgaatggtaataccgcataacatcaaggagccgcatggcactttgatcaaaggagcaa

SEQ ID NO: 279 - DNA, 225 bp, Unknown
  Encodes 16S rRNA from Saccharofermentans
agagtttgatcatggctcaggatgaacgctggcggcgtgcctaacacattcaagtcgaacggagatatacggaagcttgcttttgtatattttagtggcggacgggtgagtaatgcatgagcaacctgccttaaagagggggataacacagagaaatttgtgctaataccgcataagctgcgaaggaggcatctcccatgcagaaaaggagcaatccgctttaag

SEQ ID NO: 280 - DNA, 225 bp, Unknown
  Encodes 16S rRNA from Clostridium sensu stricto
agagtttgatcatggctcaggacgaacgctggcggcgcgcctaacacatgcaagtcgaacggaacttttgagtgacttcggtctctcttgagtttagtggcggacgggtgagtaaagcatgagtaactttcccttgagtggggaataacttttggaaacagaagataataccgcatacttcaaaggatcgcatgatcttttggcaaagattttcgcttttggata

SEQ ID NO: 281 - DNA, 225 bp, Unknown
  Encodes 16S rRNA from Roseburia
agagtttgatcatggctcaggatgaacgctggcggcgtgcctaacacatgcaagtcgaacgaagcatagagattagatttcttcggattgaagatttttatgacttagtggcgaacgggtgagtaacgcgtgggtaacctgcctcatgcagggggataacaattagaaatgattgctaataccgcataagaccgcagaaccgcatggttgagcggccaaagattt

SEQ ID NO: 282 - DNA, 225 bp, Unknown
  Encodes 16S rRNA from Lachnospiracea incertae sedis
agagtttgatcctggctcaggatgaacgctggcggcgtgcttaacacatgcaagtcgaacgaagcacttacacttgatttcttcggattgaaagagtttgtgactgagtggcggacgggtgagtaacgcgtggataacctgcccttcacagggggataacagttagaaatgactgctaataccgcataagcgcacactaaggcatcttagggtgtgaaaagctcc

SEQ ID NO: 283 - DNA, 225 bp, Unknown
  Encodes 16S rRNA from unknown taxa
agagtttgatcatggctcaggatgaacgctagcagaatgcttaacacatgcaagtcgaacgaatcttcggattagtggcagacgagcgagtaacacgtacttaacttgcccttgagttgggaacaactatagagatatagctaattcccaatatgctcacgatggtgaaatcccgatgtgaggaaagatttatcgctcaaggagaggggtgcgtcctatcaggta

SEQ ID NO: 284 - DNA, 225 bp, Unknown
  Encodes 16S rRNA from Hydrogenoanaerobacterium
agagtttgatcatggctcaggacgaacgctggcggcgcgcctaacacatgcaagtcgaacgggattgtttacaatccagtggcggacgggtgagtaatgcatgagtaatctgcctgaaagagggggatagcttctggaaacagaagataataccgcatatttcaaaatttccgcatggtttttttggcaaaggagcaatccactttcagatgagctcatgtccga

SEQ ID NO: 285 - DNA, 225 bp, Unknown
  Encodes 16S rRNA from Victivallis
agagtttgatcatggctcagaacgaacgctggcggcatggattaggcatgcaagtcgaacgaagcagcaatgcttagtggcggaagggtgaggaacgcgtgagcaacctgccctcaagttgggaataacagttggaaacgactgctaataccgaatgtggcttttgaaccgcatggtttattggctaaagatttattgcttgaggatgggctcgcgtcccattag

SEQ ID NO: 286 - DNA, 225 bp, Unknown
  Encodes 16S rRNA from Clostridium IV
agagtttgatcatggctcaggacgaacgctggcggcgtgcctaacacatgcaagtcgaacggagttcttacagatgaagcttcggccgatgaagtttgaacttagtggcggacgggtgagtaacgcgtgagcaacctgccttacagagggggacaacagttggaaacgactgctaataccgcataacgtatttggagggcatcctctggataccaaagatttatc

SEQ ID NO: 287 - DNA, 225 bp, Unknown
  Encodes 16S rRNA from Pelotomaculum
agagtttgatcatggctcaggacgaacgctggcggcgtgcctaacacatgcaagtcgaacggagtaaagagcttcggttttttacttagtggcgaacgggtgagtaacgcgtgagcaacctgactctttgagggggataacagtcggaaacaactgctaataccgcataagaccacgaaccggcatcggtatgaggtcaaaggagcaatccgcagagagaggggc

SEQ ID NO: 288 - DNA, 225 bp, Unknown
  Encodes 16S rRNA from Clostridium XlVa
agagtttgatcatggctcaggatgaacgctggcggcgtgcctaacacatgcaagtcgaacgaagcacttctcccgtcaaagtagattagcttgctatgaagcggagacatttgaagtgacttagtggcggacgggtgagtaacgcgtgggtaacctgccctgtactgggggacaacagttggaaacggctgctaataccgcataagcgcacagcatcgcatggtg

SEQ ID NO: 289 - DNA, 225 bp, Unknown
  Encodes 16S rRNA from Saccharofermentans
agagtttgatcatggctcaggatgaacgctggcggcgtgcttaacacattcaagtcgaacgagcgaggggaagcaattccctttgctagtggcggacgggtgagtaacgcgtgagcaacctacctttacgagtgggataacaattggaaacgattgctaataccgcataacgtatagatatcgcatgacatttataccaaagaaaatcgcgtaaagatgggctcg

SEQ ID NO: 290 - DNA, 225 bp, Unknown
  Encodes 16S rRNA from Lachnospiracea incertae sedis
agagtttgatcatggctcaggatgaacgctggcggcgtgcctaacacatgcaagtcgaacgggaaccttgtgacggagacttcggtcaaagatgcaagaattctagtggcggacgggtgagtaacgcgtgggtaacctgcccttaagaggcgaataacagtgagaaatcactgctaatacgccatatgcttacggaatcgcatgattttgtgaggaaaagaattt

SEQ ID NO: 291 - DNA, 225 bp, Unknown
  Encodes 16S rRNA from Coprococcus
agagtttgatcctggctcaggatgaacgctggcggcgtgcttaacacatgcaagtcgaacgaagcacttacgattgactggagagcttgctcgaagggattttgtttgtgacttagtggcggacgggtgagtaacgcgtgggtaacctgcctcatacagggggataacagttggaaacgactgttaataccgcataagcgcacggtatcgcatgatacagtgtga

SEQ ID NO: 292 - DNA, 225 bp, Unknown
  Encodes 16S rRNA from Clostridium XlVa
agagtttgatcatggctcaggatgaacgctggcggcgtgcttaatacatgcaagtcgaacgaggaattgcgattgaagttttcggatggatttcgcttttccgagtggcggacgggtgagtaacgcgtgggtaacctgccttacacagggggacaacagctggaaacggctgctaataccgcataacccgctagagtcgcatgactcagacggaaaagatttatc

SEQ ID NO: 293 - DNA, 225 bp, Unknown
  Encodes 16S rRNA from Clostridium XlVb
agagtttgatcatggctcaggatgaacgctggcggcgtgcttaacacatgcaagtcgagcgaaggacaaagagcttgctctttgttacttagcggcggacgggtgagtaacgtgtgggcaatctgccctatgcagaggaataacatagagaaatttatgctaatgcctcataaactcttagtactgcatggtacatagagaaaagatttatcggcataggaggag

SEQ ID NO: 294 - DNA, 225 bp, Unknown
  Encodes 16S rRNA from Papillibacter
agagtttgatcatggctcaggatgaacgctggcggcgtgcctaacacattcaagtcgaacggacgagagggggcttgctccctcaagttagtggcggacgggtgagtaacgcgtgagcaacctgccttttttcgggggataacacggggaaaccggtgctaataccgcataacgtaccgagaccgcatgatcatggtaccaaaggagcaatccgaggaaagatgg

SEQ ID NO: 295 - DNA, 225 bp, Unknown
  Encodes 16S rRNA from Bartonella
agagtttgatcctggctcagaacgaacgctgtcgacatgcttaacacatgcaagtcgtacgggtataacttgttataccagtggcaaacgggtgagtaatgcgtaggaatgtacccaatagtctcgaataacaattggaaacgattgataatacgagatacaatggaacatgggaccatgtgacatgaaaggttcagcaatggactgctataggagcagcctacg

SEQ ID NO: 296 - DNA, 225 bp, Unknown
  Encodes 16S rRNA from Clostridium IV
agagtttgatcatggctcaggatgaacgctggcggcgtgcttaacacattcaagtcgaacgagcgagaggaagcaattccttttgctagtggcggacgggtgagtaacgcgtgagcaacctacctttgtgagtgggataacaattggaaacgattgctaataccgcataacgtatagatattgcatgataactataccaaagaaattcgcacaaagatgggctcg

SEQ ID NO: 297 - DNA, 225 bp, Unknown
  Encodes 16S rRNA from Eubacterium
agagtttgatcatggctcaggattaacgctggcggcgtgcctaacacatgcaagtcgagcgagaattaaagaaatgattcttcggatgaatttctttaaggacagcggcggacgggtgagtaacgcgtgggcaacctgcccctttccggaggatagccaagggaaactttgaataatactccataaagcatttttgccgcatgacagagatgccaaagatttatc

SEQ ID NO: 298 - DNA, 225 bp, Unknown
  Encodes 16S rRNA from Asaccharobacter
agagtttgatcctggctcaggatgaacgctggcggcgtgcttaacacatgcaagtcgaacgggaaagcgccctcgggcgcgagtacagtggcgaacgggtgagtaacacgtgaccaacctgccccccgcaccgggatagccgggcgaaagcccgggtaataccggatgaccccgcaccgcggcatcgcggcgcgggcaaagcccagacggcgggggatggggtcg

SEQ ID NO: 299 - DNA, 225 bp, Unknown
  Encodes 16S rRNA from Clostridium IV
agagtttgatcatggctcaggatgaacgctggcggcgtgcataacacattcaagtcgaacggactgatttgatagcttgctattgatgaaagttagtggcggacgggtgagtaacgcgtgagcaacctgcccctatgtgcgggataacgtttggaaacggacgctaataccgcataatccaatggaatcgcatggttttattggcaaagatttattgcataggga

SEQ ID NO: 300 - DNA, 225 bp, Unknown
  Encodes 16S rRNA from Blautia
agagtttgatcatggctcaggatgaacgctggcggcgtgcctaacacatgcaagtcgaacggagcttattttttggagacttcggtcaaagaagcttaagcttagtggcggacgggtgagtaacgcgtggagaacctgccctgtaccgggggataacagccggaaacggctgctaataccgcataagcgcacgaggccgcatggccctgtgtgaaaaactccggt

SEQ ID NO: 301 - DNA, 225 bp, Unknown
  Encodes 16S rRNA from Prevotella
agagtttgatcatggctcaggatgaacgctagctacaggcttaacacatgcaagtcgaggggcatcactggggtggcttgccatccctggtggcgaccggcgcacgggtgagtaacgcgtatccaacctgccccgaaccgcggtatagcccgccgaaaggcggattaatcccgcatgtggtcgtgagatgacatctgaccacgactaaaggtattttccggttcg

SEQ ID NO: 302 - DNA, 225 bp, Unknown
  Encodes 16S rRNA from Ruminococcus
agagtttgatcatggctcaggacgaacgctggcggcacgcttaacacatgcaagtcgaacgaattagtttcaccgtagcttgctacaccgagactaattagtggcggacgggtgagtaacacgtgagcaatctgcctttcagagggggataccagttggaaacgactgttaataccgcataacatatgtttaccgcatgatagacatatcaaagatttatcgctg

SEQ ID NO: 303 - DNA, 150 bp, Unknown
  Encodes 16S rRNA from Selenomonas
agagtttgatcatggctcaggatgaacgctagctacaggcttaacacatgcaagtcgaggggacgaatgttgaggcctagaacataggtttcaaatgacggtacctgacgaggaagccacggctaactacgtgccagcagccgcggtaat

SEQ ID NO: 304 - DNA, 225 bp, Unknown
  Encodes 16S rRNA from Treponema
agagtttgatcatggctcagaacgaacgctggcggcgcgtcttaagcatgcaagtcgaacgggatccacgcgcttgcgcgtggtgagagtggcggactggtgagtaacgcgtaggtgacgtaccctccggacggggatagcccttagaaataaggggtaataccggatacggttccgtgtgtcagaggcacggaaggaaaggagcttcggctccgccgggggatc

SEQ ID NO: 305 - DNA, 225 bp, Unknown
  Encodes 16S rRNA from Adlercreutzia
agagtttgatcatggctcaggatgaacgctggcggcgtgcttaacacatgcaagtcgaacgattaaagccccttcgggggtgtatagagtggcgaacgggtgagtaacacgtgagcaacctacctctcacaccgggataacatatggaaacgtatgctaataccggatactccggaacttacgcatgttcgttccgggaaagctccgacggtgagagatgggctc

SEQ ID NO: 306 - DNA, 225 bp, Unknown
  Encodes 16S rRNA from Butyricicoccus
agagtttgatcatggctcaggacgaacgctggcggcgtgcctaacacatgcaagtcgaacggaactattttgactgattccttcgggatgaagaatttttagtttagtggcgatcggtagccggactgagaggttgaacggccacattgggactgagacacggcccagactcctacgggaggcagcagtgggggatattgcgcaatgggggcaaccctgacgcag

SEQ ID NO: 307 - DNA, 225 bp, Unknown
  Encodes 16S rRNA from Pseudoflavonifractor
agagtttgatcatggctcaggacgaacgctggcggcgtgcttaacacatgcaagtcgaacgaggaatgttgaaaagcttgctttttaacatttcgagtggcggacgggtgagtaacgcgtgaggaacctgtcttctacagggggataacgtcccgaaagggacgctaataccgcataagaccacggtatcgcatgatacaggggtcaaaggagcaatccggtaga

SEQ ID NO: 308 - DNA, 225 bp, Unknown
  Encodes 16S rRNA from Corynebacterium
agagtttgatcctggctcaggacgaacgctggcggcgtgcttaacacatgcaagtcgaacggtaaggccccagcttgctggggtacacgagtggcgaacgggtgagtaacacgtgggtgacctgccccgcacttcgggataagcctgggaaactgggtctaataccggataggaccgcaccgtgagggtgtggtggaaagtttttcggtgtgggatgggcccgcg

SEQ ID NO: 309 - DNA, 225 bp, Unknown
  Encodes 16S rRNA from Adlercreutzia
agagtttgatcatggctcaggatgaacgctggcggcgtgcttaacacatgcaagtcgaacggttaaagccccttcgggggtgtataaagtggcgaacgggtgagtaacacgtgagcaacctacctctcacaccgggataacaactggaaacggttgataataccggatactccgattggatcgcatgttcctttcgggaaagctccgacggtgagagatgggctc

SEQ ID NO: 310 - DNA, 225 bp, Unknown
  Encodes 16S rRNA from Selenomonas
agagtttgatcctggctcaggacgaacgctggcggcgtgcttaacacatgcaagtcgaacgagacgattgaaagcttgcttttgagagtcgagtggcaaacgggtgagtaacgcgtagacaacctgccgcaaagatggggacaacagtccgaaaggactgctaataccgaatgttgtgcaatctccgcatggaggatgcattaaagatggcctctacttgtaagc

SEQ ID NO: 311 - DNA, 225 bp, Unknown
  Encodes 16S rRNA from Coraliomargarita
agagtttgatcatggctcagagtgaacgctggcgacgtggctaagacatgcaagtcgagcgagaaggtgccttcgggtgccggaaagcggcaaacgggtgcgtaacacgtaagtaacctgcccttaagacgggaatagcttgatgaaaattgagataatgcccgatatcgaattcttccgcatgggagaagtttgaaaggtttgtgatgacgcttaaggaggggc

SEQ ID NO: 312 - DNA, 225 bp, Unknown
  Encodes 16S rRNA from Paraprevotella
agagtttgatcatggctcaggatgaacgctagcggcaggcttaacacatgcaagtcgaggggcagcgagtcggtagcaatactgatgtcggcgaccggcgcacgggtgagtaacgcgtatgcaacctttcccagacagggggatagcccagggaaacttggattaataccccgtaggccagaggagggcatcctcgtctggttaaagttccggcggtctggggtg

SEQ ID NO: 313 - DNA, 225 bp, Unknown
  Encodes 16S rRNA from Oscillibacter
agagtttgatcatggctcaggacgaacgctggcggcgtgcctaacacatgcaagtcgaacgggacttattggaatgagacttcggtcaaaggaaaataagtttagtggcggacgggtgagtaacgcgtgagcaacctgcctttcagagggggacaacagttggaaacgactgctaataccgcataacgtgtattggaggcatcttcggtacaccaaagatttatc

SEQ ID NO: 314 - DNA, 225 bp, Unknown
  Encodes 16S rRNA from Anaerovorax
agagtttgatcatggctcaggatgaacgctggcggcgtgcctaacacatgcaagtcgagcgagaaacctttgattgacacttcggttgatttcaaaggcggaaagcggcggacgggtgagtaacgcgtaggcaacctgccccttgcagagggatagcctcgggaaaccgggattaaaacctcataacaccgaacctacacatgttcgatcggtcaaagatttatc

SEQ ID NO: 315 - DNA, 225 bp, Unknown
  Encodes 16S rRNA from Clostridium XlVa
agagtttgatcctggctcaggatgaacgctggcggcgtgcataacacatgcaagtcgaacggagttacattgaaacctagtgatatgtaacttagtggcggacgggtgagtaacgcgtgggtaacctacctggtattgggggacaacagttagaaatgactgctaataccgcatacgtcatcgagagggcatcctcttgatgagaaaggagcaatccgacatcag

SEQ ID NO: 316 - DNA, 225 bp, Unknown
  Encodes 16S rRNA from Saccharofermentans
agagtttgatcatggctcaggacgaacgctggcggcgtgcctaacacatgcaagtcgagcggagtaagtggagagcttgcttgaaacttacttagcggcggacgggtgagtaacgcgtgagcaacctgtcctctgcagggggataagacagcgaaagttgttctaataccgcatgagaccacaacgtcacatggcgaaggggtcaaaggaggaatccggcagagg

SEQ ID NO: 317 - DNA, 225 bp, Unknown
  Encodes 16S rRNA from Erysipelothrix
agagtttgatcatggctcaggatgaacgctggcggcgtgcctaatacatgcaagtcgaacggggtaccttcgggtacctagtggcgaacgggtgagtaacacataaacaatctgccctggagactgggataccgtcgggaaaccgacgctaataccggataggcagtaagggggcatctccatactgttaaagctgggttgcagcgctgcaggatgagtttatgt

SEQ ID NO: 318 - DNA, 225 bp, Unknown
  Encodes 16S rRNA from Agaricicola
agagtttgatcatggctcagaacgaacgctggcggcaggcttaatccatgcaagtcaagggggtgtagcaatacacaaccggcgtacgggtgagtaacgcgtgggaatgtgtccatttgtggggaatagcttctggaaacggaaggtaataccgcatacgcccttcgggggaaagatttatcgcagatggagcggcccgcgttagattagctagttggtggggta

SEQ ID NO: 319 - DNA, 225 bp, Unknown
  Encodes 16S rRNA from Denitrobacterium
agagtttgatcatggctcaggatgaacgctggcggcgtgcctaacacatgcaagtcgaacgaataacccgccttcgggcggtcatagagtggcgaacgggtgagtaacacgtgaccaaccttccccccgcatggggataaccgggcgaaagcccggctaatacccaatactccgggccctccgcatggaggggccgggaaagcccaggcggcgggggatggggtc

SEQ ID NO: 320 - DNA, 225 bp, Unknown
  Encodes 16S rRNA from unknown taxa
agagtttgatcatggctcaggacgaacgctagcgacgtgcctaagaaatgcaagtcgagcgatgacggtggcttcggctgcctgattagcggcgaacggtcgcgtaacacgtaagcaatctgccccaaagtttgggatagccatccgaaaggatgattaataccggatgtggaatatatatcgcatgttatatattctaaagtagcgatacgctttgggatgagc

SEQ ID NO: 321 - DNA, 225 bp, Unknown
  Encodes 16S rRNA from Asaccharobacter
agagtttgatcctggctcaggatgaacgctggcggcgtgcttaacacatgcaagtcgaacgattaaaccggcttcggccggatatagagtggcgaacgggtgagtaacacgtgaccaacctgccccccgcttcgggataactgctggaaacggcagctaataccggatactccttcagcaccgcatggtgctccagggaaagatttatcggcgagggatggggtc

SEQ ID NO: 322 - DNA, 225 bp, Unknown
  Encodes 16S rRNA from Anaeroplasma
agagtttgatcatggctcaggattaacgctggcggcatgcctaatacatgcaagtcgaatgaattagattcatggcgaacgggtgagtaacacgtaggtaatctaccataaagacaaggataaccattggaaacgatggataagactcgataggacacgaagtcgcatgactttgtgtttaaaggttacgctttatgaggagcctgcggtgcattagctagttgg

SEQ ID NO: 323 - DNA, 225 bp, Unknown
  Encodes 16S rRNA from Prevotella
agagtttgatcctggctcaggatgaacgctagctacaggcttaacacatgcaagtcgaggggcagcatgacggtagcttgctatcgttgatggcgaccggcgcacgggtgagtaacgcgtatccaaccttcccatgactccggttcagcccgccgaaaggcggattactcccggatggtttccgaagagggcctctgatttggaataaagattcatcggtcatgg

SEQ ID NO: 324 - DNA, 225 bp, Unknown
  Encodes 16S rRNA from Lachnospiracea incertae sedis
agagtttgatcctggctcaggatgaacgctggcggcgtgcttaacacatgcaagtcgaacgaggaactgtgaatgaaattttcggatggatttcgcttttccgagtggcggacgggtgagtaacgcgtggataacctgcccttcacagggggacaacagtcggaaacgactgctaataccgcataagccgacggagtcgcatgactcagccggaaaagatttatc

SEQ ID NO: 325 - DNA, 225 bp, Unknown
  Encodes 16S rRNA from Clostridium IV
agagtttgatcatggctcaggacgaacgctggcggcgtgcctaacacatgcaagtcgagcggacttatagatagaaagtgcttgcactggacatttacaagttagcggcggacgggtgagtaacgcgtgagcaacctgtcctctacagggggataagatctcgaaagggattctaataccgcatgagaccacagcagggcatcctgcgggggtcaaaggaggaat

SEQ ID NO: 326 - DNA, 225 bp, Unknown
  Encodes 16S rRNA from Streptococcus
agagtttgatcctggctcaggacgaacgctggcggcgtgcctaatacatgcaagtagaacgctgaagactttagcttgctaaagttggaagagttgcgaacgggtgagtaacgcgtaggtaacctgcctactagcgggggataactattggaaacgatagctaataccgcataacagcatttaacccatgttagatgcttgaaaggagcaattgcttcactagta

SEQ ID NO: 327 - DNA, 166 bp, Unknown
  Encodes 16S rRNA from Cellulosilyticum
agagtttgatcatggctcaggatgaacgctggcggcgtgcttaacacatgcaagtcgaacggagtttaagaaggttttcggattgtaaactcctgtttcgagggacgataatgacggtacctcgggaggaagctccggctaactacgtgccagcagccgcggtaat

SEQ ID NO: 328 - DNA, 225 bp, Unknown
  Encodes 16S rRNA from Asaccharobacter
agagtttgatcctggctcaggatgaacgctggcggcgtgcttaacacatgcaagtcgaacgattaaagcgccttcgggcgtgtatagagtggcgaacgggtgagtaacacgtgatcaacctacctcgtacttcgggatagcctcgtgaaaacgggattaataccggatactccgattaaatcgcatgattctttcgggaaagcctttacggtacgagatgggatc

SEQ ID NO: 329 - DNA, 225 bp, Unknown
  Encodes 16S rRNA from Enterorhabdus
agagtttgatcctggctcaggatgaacgctggcggcgtgcctaacacatgcaagtcgaacggttaaaccggcttcggccggaaataaagtggcgaacgggtgagtaacacgtgaccaacctgccccgcgcaccgggacagccccccgaaagggggattgataccggatactccgccgggcccgcatgggcccggcgggaaagctccggcggcgcgggatggggtc

SEQ ID NO: 330 - DNA, 225 bp, Unknown
  Encodes 16S rRNA from Treponema
agagtttgatcctggctcagaacgaacgctggcggcgcgtcttaagcatgcaagtcgagcgggattcatgtgcttgcacatgatgagagcggcggactggtgagtaacacgtaggtgacgtaccttgaggacggggacagccggcagaaatgccgggtaataccggataagctcgcgcgagccggaatcgcgcgaggaaaggagctaaggctccgcctctagagc

SEQ ID NO: 331 - DNA, 225 bp, Unknown
  Encodes 16S rRNA from Roseburia
agagtttgatcctggctcaggatgaacgctggcggcgtgcctaacacatgcaagtcgaacggagcacattaagcgagaccttcgggtggaactttttatgcttagtggcggacgggtgagtaacgcgtgggtaacctgccttatacagggggataacagagagaaatttctgctaataccccataagcgcacagtatcgcatgatacagggtgaaaaggatttcc

SEQ ID NO: 332 - DNA, 225 bp, Unknown
  Encodes 16S rRNA from Victivallis
agagtttgatcctggctcagaacgaacgctggcggcatggattaggcatgcaagtcgaacgaagcagcaatgcttagtggcggaagggtgaggaacgcgtgagtaatctgccctcaagttgggaataacagctggaaacggctgctaataccgaatgtggctgcaagaccgcatgattttgcagttaaagatttattgcttgaggatgagctcgcgtcccattag

SEQ ID NO: 333 - DNA, 225 bp, Unknown
  Encodes 16S rRNA from Prevotella
agagtttgatcatggctcaggatgaacgctagctacaggcttaacacatgcaagtcgcggggcatcatgaagggagcttgctctctttgatggcgaccggcgcacgggtgagtaacgcgtatccaacctgccccctagtagggaacagcccgtagaaatgcggattaatgccctatgttctccgaagacggcatcagattcggagcaaaggcctttggccgctag

SEQ ID NO: 334 - DNA, 225 bp, Unknown
  Encodes 16S rRNA from Roseburia
agagtttgatcctggctcaggatgaacgctggcggcgtgcttaacacatgcaagtcgaacggagatatcggcttcggctgatatctcagtggcggacgggtgagtaacgcgtgggtaacctgccttacaccgggggacaacagttggaaacgactgctaataccgcataagaccacggagccgcatggccctggggtaaaagatttatcgatgtaagatggaccc

SEQ ID NO: 335 - DNA, 225 bp, Unknown
  Encodes 16S rRNA from Ruminococcus
agagtttgatcctggctcaggacgaacgctggcggcacgcctaacacatgcaagtcgaacggtgaatgattagcttgctagacattcatagtggcggacgggtgagtaacacgtgagcaacctgcctctgagagagggatagcttctggaaacggatggtaatacctcatgatatagcattctcgcatgggaatgctatcaaatgaatttcgctcagagatgggc

SEQ ID NO: 336 - DNA, 225 bp, Unknown
  Encodes 16S rRNA from Mogibacterium
agagtttgatcatggctcaggatgaacgctggcggcgtgcctaatacatgcaagtcgagcgagaaatctttcagacgattcttcggatgagtcaggaagatggaaagcggcggacgggtgagtaacgcgtaggcaacctgccctcagcagagggatagccattggaaacgatgattaaaacctcataatgctgaaccaacacatgttggatcagccaaagattta

SEQ ID NO: 337 - DNA, 225 bp, Unknown
  Encodes 16S rRNA from Lachnospiracea incertae sedis
agagtttgatcctggctcaggatgaacgctggcggcgtgcttaacacatgcaagtcgaacgaagcatagtgaatgaagttttcggatggatttcactttgacttagtggcggacgggtgagtaacgcgtgggcaacctgcccttaaccgggggacaacagttggaaacgactgctaataccgcataagcgcacgtgaccgcatggtcgagtgtgaaaaattccgg

SEQ ID NO: 338 - DNA, 225 bp, Unknown
  Encodes 16S rRNA from Prevotella
agagtttgatcatggctcaggatgaacgctagctacaggcttaacacatgcaagtcgaggggcagcatgtcgtgtgcttgcacacgatgatggcgaccggcgcacgggtgagtaacgcgtatccaacctgcccatgaccccgggatagcccgctgaaaagcggattaacaccggatgcggtcgaaagaggacatctgatttcgaccaaagcttttgcggtcatgg

SEQ ID NO: 339 - DNA, 225 bp, Unknown
  Encodes 16S rRNA from Clostridium sensu stricto
agagtttgatcatggctcaggacgaacgctggcggcatgcctaacccatgcaagtcgaacggacgagacgacttcggttgtcaagtcagtggcggacgggtgagtaacacgtgaacaaccaacctcatactgggggacaacatttggaaacgaatgctaataccgcataagaccacagagccgcatggctcagaggtcaaaggagaaatccggtatgagacgggt

SEQ ID NO: 340 - DNA, 225 bp, Unknown
  Encodes 16S rRNA from Victivallis
agagtttgatcctggctcagaacgaacgctggcggcatggattaggcatgcaagtcgaacgaagcagcaatgcttagtggcgcaagggtgaggaacacgtgagtgacctacccgcaagtttggaacagctcctggaaacgggaattaataccggatgtgatcatgaagctgcatggtttcatgattaaagcagcaatgcgcttgcggatgggctcgcgtcccatt

SEQ ID NO: 341 - DNA, 225 bp, Unknown
  Encodes 16S rRNA from unknown taxa
agagtttgatcctggctcaggacgaacgctggcggtgtgcctcatacatgcaagtcgaacgataaggtctcttcggagatacataagtggcggacgggtgagtacaacataggaaatctgccttaaggcgggggacaacagagggaaacttctgctaataccccatatgagctaagctgaaatgcttatcttgaaagctccggcgccttgagatgagcctgtgcc

SEQ ID NO: 342 - DNA, 225 bp, Unknown
  Encodes 16S rRNA from Treponema
agagtttgatcctggctcagaacgaacgctggcggcgcgtcttaagcatgcaagtcgagcgggaataagggagcttgcttccttatgagagcggcggactggtgagtaacacgtgggtaacgcatcctcctgacggggacagcctgtggaaacacagggtaataccggatgagatggacttctggaagggagttcatgaaaggagctacggctccgcagggggaa

SEQ ID NO: 343 - DNA, 225 bp, Unknown
  Encodes 16S rRNA from Stenotrophomonas
agagtttgatcctggctcagagtgaacgctggcggtaggcctaacacatgcaagtcgaacggcagcacaggggagcttgctccccgggtggcgagtggcggacgggtgaggaatgcatcggaatctactctttcgtgggggataacgtagggaaacttacgctaataccgcatacgacctacgggtgaaagcaggggaccttttaggccttgcgcgattgaatga

SEQ ID NO: 344 - DNA, 225 bp, Unknown
  Encodes 16S rRNA from unknown taxa
agagtttgatcatggctcaggatgaacgctagcagaacgcctaacacatgcaagtcgaacgccccgatttatcggggagtggcagacgagcgagtaacacgtacttaacttgcccttgagatgggaacaactgcagagatgtagctaattcccaatatgctcacgatggtgaaatcccaatgtgaggaaagatttatcgctcaaggagaggggtgcgtcctatca

SEQ ID NO: 345 - DNA, 225 bp, Unknown
  Encodes 16S rRNA from Clostridium XlVa
agagtttgatcctggctcaggatgaacgctggcggcgtgcctaacacatgcaagtcgaacgggaacctcacagtggagacttcggtcaaagcagtgagaattctagtggcggatgggtgagtaacgcgtgggtaacctgcctataagaattggataacagtgagaaatcactgctaatacaatataagcttacagtatcgcatgataaagtgagaaaagatttat

SEQ ID NO: 346 - DNA, 225 bp, Unknown
  Encodes 16S rRNA from Sphingobium
agagtttgatcctggctcagagtgaacgctagcggaatgctttatacatgcaagtcgaacggaaaattagaaggagtagcaatacaaatttgaagtttttagtggcgaactggcgagtaatagttaggaacttaccgagtagtgggggacaacagttagaaatgactgctaataccgcatacgcccgagaggggaaagatttatcgctatttgagaggcctaacc

SEQ ID NO: 347 - DNA, 184 bp, Unknown
  Encodes 16S rRNA from Lachnospiracea incertae sedis
agagtttgatcatggctcaggataaacgctggcggcgtgctttggacaatgggggcaaccctgatccagcgacgccgcgtgagcgaagaagtatctcggtatgtaaagctctatcagcagggaagataatgacggtacctgactaagaagcaccggctaaatacgtgccagcagccgcggtaat

SEQ ID NO: 348 - DNA, 225 bp, Unknown
  Encodes 16S rRNA from Oscillibacter
agagtttgatcatggctcaggatgaacgctggcggcgtgcttaacacatgcaagtcgaacggacgaggcggagcttgctctgccgagttagtggcggacgggtgagtaacgcgtgagcaacctgcctttcagagggggacaacgttgggaaaccggcgctaataccgcataatatgcttttgccgcatgacagaagtatcaaaggagcaatccgctgaaagatgg

SEQ ID NO: 349 - DNA, 225 bp, Unknown
  Encodes 16S rRNA from Methylobacterium
agagtttgatcatggctcagagcgaacgctggcggcaggcttaacacatgcaagtcgagcggacctttcggggtcagcggcggacgggtgagtaacgcgtgggaacgtgccttccggttcggaataaccctgggaaactagggctaataccggatacgcccttatggggaaaggtttactgccggaagatcggcccgcgtctgattagctagttggtggggtaac

SEQ ID NO: 350 - DNA, 225 bp, Unknown
  Encodes 16S rRNA from Zhangella
agagtttgatcctggctcagaacgaacgctggcggcatgcttaacacatgcaagtcgaacggtgttgcatagcacttgtgttatgtaacatagtggcaaacgggtgagtaacgcgtggaaacatacccctcagtattggataacgtttggaaacgaacgctaatacaatatacgctcgagagaggaaagagagatcgctgagggagtggtccgcgtcagattaga

SEQ ID NO: 351 - DNA, 225 bp, Unknown
  Encodes 16S rRNA from Lachnospiracea incertae sedis
agagtttgatcctggctcaggatgaacgctggcggcgtgcttaacacatgcaagtcgaacggagttgtttcaccgaatgaactggagagcttgctcaaaggggaattcaccgagacaacttagtggcggacgggtgagtaacgcgtgggtaacctacccttatcagggggataacagtcggaaacgactgctaataccgcataagcgcacagtatcgcatgatac

SEQ ID NO: 352 - DNA, 225 bp, Unknown
  Encodes 16S rRNA from Oscillibacter
agagtttgatcatggctcaggacgaacgctggcggcgtgcctaacacatgcaagtcgaacgaagctcttttcaatgcgattcgtcaagttgaaaggatgacttagtggcgaacgggtgagtaacgcgtgagcaacctgccccggagtgggggacaacagttggaaacgactgctaataccgcatgacatgttcggatggcatcatctgaacatcaaagatttatt

SEQ ID NO: 353 - DNA, 225 bp, Unknown
  Encodes 16S rRNA from Clostridium III
agagtttgatcatggctcaggacgaacgctggcggcgtgcctaacacatgcaagtcgaacgaacttactagcaatagtaagttagtggcggacgggtgagtaatacatgagtaacctgccttatacagggggataacacctagaaatgggtgctaataccgcataataactcagtatggcatcatattgagaggaaaggagcaatccggtaaaagatggactcat

SEQ ID NO: 354 - DNA, 225 bp, Unknown
  Encodes 16S rRNA from Coraliomargarita
agagtttgatcctggctcagagtgaacgctggcggcgtggctaagacatgcaagtcgagcgagaaggtgccttcgggtgccggaaagcggcaaacgggtgcgtaacacgtaagtaacctgcccttaagacgggaacagcttgatgaaaattgagataatgcccgatatccgcttctttcgcatgggagaagtcggaaaggtttgtgatgacgcttaaggaggggc

SEQ ID NO: 355 - DNA, 225 bp, Unknown
  Encodes 16S rRNA from Eubacterium
agagtttgatcatggctcaggattaacgctggcggcgtgcctaacacatgcaagtcgagcgagaagtggtgaaatgaaacttcggtagattggatccatggacagcggcggacgggtgagtaacgcgtgggcaacctgcccctttccggaggatagccaagggaaactttgaataatactccataaagcaagagtaccgcatgatacacttgccaaagatttatc

SEQ ID NO: 356 - DNA, 225 bp, Unknown
  Encodes 16S rRNA from Enterorhabdus
agagtttgatcatggctcaggatgaacgctggcggcgtgcctaacacatgcaagtcgaacggttaaaccgccctcgggcggacatagagtggcgaacgggtgagtaacacgtgaccaacctgccccgcgcaccgggacagccccccgaaagggggattaataccggatactccggggcccccgcatgggggccccgggaaagcccaggcggcgcgggatggggtc

SEQ ID NO: 357 - DNA, 225 bp, Unknown
  Encodes 16S rRNA from Clostridium XlVa
agagtttgatcatggctcaggatgaacgctggcggcgtgcttaacacatgcaagtcgaacgaatttcttattcgcggaggcttcggccgaaggggatatgaagtgagtggcggacgggtgagtaacgcgtgggtaacctgccttacaccgggggataacagagggaaacttctgctaataccgcataagaccacagtgccgcatggtacagaggtaaaagttccg

SEQ ID NO: 358 - DNA, 225 bp, Unknown
  Encodes 16S rRNA from Saccharofermentans
agagtttgatcctggctcaggatgaacgctggcggcgtgcttaacacatgcaagtcgaacgggaagacttttaggaagatttcggttggaataaaagtattctagtggcggacgggtgagtaacgcgtaaacaatctgccttagagagggggataacagatagaaatatttgctaataccgcataagaccacgtttaggcatctagatggggtaaaaggagcaat

SEQ ID NO: 359 - DNA, 225 bp, Unknown
  Encodes 16S rRNA from Clostridium IV
agagtttgatcatggctcaggatgaacgctggcggcgtgcttaacacattcaagtcgaacggacaagagggggcttgctcccttgcgttagtggcggacgggtgagtaacgcgtgagcaacctgcctttctccgggggataacattgggaaaccggtgctaataccgcataacgtacagagatcacatggtcattgtaccaaagatttatcggggaaagatgggc

SEQ ID NO: 360 - DNA, 225 bp, Unknown
  Encodes 16S rRNA from Clostridium sensu stricto
agagtttgatcatggctcaggacgaacgctggcggcgtgcctaacacatgcaagtcgagcggggactgcacgacggatttgaagatttcggttggatatgaagatgtacagttctagcggcggacgggtgagtaacgcgtgagcaacctgtcccttacagggggataacacagcgaaagttgtactaataccgcatgagaccacgatatcacatggtataggggt

SEQ ID NO: 361 - DNA, 225 bp, Unknown
  Encodes 16S rRNA from Victivallis
agagtttgatcctggctcagaacgaacgctggcggcatggattaggcatgcaagtcgaacgaagcagcaatgcttagtggcggaagggtgaggaacgcgtgagtaatctgcccccaagttgggaataacagttggaaacgactgctaataccgaatgtggctgcgaagtcgcatgattttgcagttaaagatttattgcttggggatgagctcgcgtcccattag

SEQ ID NO: 362 - DNA, 225 bp, Unknown
  Encodes 16S rRNA from Coprococcus
agagtttgatcatggctcaggatgaacgctggcggcgtgcttaacacatgcaagtcgaacggagtacttacgctgatgaagcttcggcagagtcttgtaagtacttagtggcggacgggtgagtaacgcgtgggtaacctgccttataccgggggataacgtctggaaacggacgctaataccgcataagcgcacgatgaggcatcttgttgtgtgaaaaactcc

SEQ ID NO: 363 - DNA, 225 bp, Unknown
  Encodes 16S rRNA from Pseudoflavonifractor
agagtttgatcatggctcaggacgaacgctggcggcgtgcttaacacatgcaagtcgaacgaggataatgacttcggttgttattcgagtggcggacgggtgagtaacgcgtgagcaatctgtccttaagagggggataacaactggaaacagttgctaataccgcataagaccacggcctcacatggggctgaggtaaaagaagcaattcgcttaagggtgagc

SEQ ID NO: 364 - DNA, 225 bp, Unknown
  Encodes 16S rRNA from Anaeroplasma
agagtttgatcatggctcaggattaacgctggcggcgtgcctaatacatgcaagtcgaatggttagcttgctaaccatggcgaacgggtgagtaacacgtaggcaacctgtctaagagacgaggataaccattggaaacgatggataatactggataggatataataaggcatcttgttatatttaaagatttatcacttttagaggggcctgcggcgcattagc

SEQ ID NO: 365 - DNA, 225 bp, Unknown
  Encodes 16S rRNA from Anaeroplasma
agagtttgatcatggctcaggattaacgctggcggcgtgcctaatacatgcaagtcgaatggtggtagcaatacaaaccatggcgaacgggtgagtaacacgtaggtaacctatcttactgacgaggataaccgttggaaacgacggataatactggataggacatcataaagggcatccttagatgtttaaaggagcaatccacggtaagaggggcctgcggcg

SEQ ID NO: 366 - DNA, 225 bp, Unknown
  Encodes 16S rRNA from Bacteroides
agagtttgatcctggctcaggatgaacgctagctacaggcttaacacatgcaagtcgaggggcagcattaagtcagcttgctgatttagatggcgaccggcgcacgggtgagtaacgcgtatccaacctgccccctacccggggatagccttgcgaaagtaagattaatacccggtgctgttatgattccgcatgggaatataacgaaagattcatcggtagggg

SEQ ID NO: 367 - DNA, 225 bp, Unknown
  Encodes 16S rRNA from Acinetobacter
agagtttgatcatggctcagattgaacgctggcggcaggcttaacacatgcaagtcgagcggggatagggtgcttgcacctgattcctagcggcggacgggtgagtaatgcttaggaatctgcctattagtgggggacaacgttccgaaagggacgctaataccgcatacgtcctacgggagaaagcaggggatcttcggaccttgcgctaatagatgagcctaa

SEQ ID NO: 368 - DNA, 225 bp, Unknown
  Encodes 16S rRNA from Victivallis
agagtttgatcctggctcagaacgaacgctggcggcatggattaggcatgcaagtcgaacgaagcagcaatgcttagtggcggaagggtgaggaacgcgtgagtaatctgccctcaagttgggaataacagctggaaacggctgctaataccgaatgtggctgttgggtcgcatgatctgacagttaaagatttattgcttgaggatgagctcgcgtcccattag

SEQ ID NO: 369 - DNA, 225 bp, Unknown
  Encodes 16S rRNA from Victivallis
agagtttgatcctggctcagaacgaacgctggcggcatggattaggcatgcaagtcgaacgggtgcagcaatgcaccagtggcgcaagggtgaggaacacgtgagtaatctaccctcaagattgggatagctcctggaaacgggaattaataccggatgaaacagtatgtccgcatggatgtacttttaaagcagcaatgcgcttgaggaggagctcgcgtccca

SEQ ID NO: 370 - DNA, 225 bp, Unknown
  Encodes 16S rRNA from Mogibacterium
agagtttgatcatggctcaggatgaacgctggcggcgtgcctaatacatgcaagtcgagcgagattctgtcagatgagacttcggtggattcagacggatgaaagcggcggacgggtgagtaacgcgtaggcaacctgccccatgcacagggatagccactggaaacggtgattaatacctgataatgcggaccgtatgcatatacggactgccaaagatttatc

SEQ ID NO: 371 - DNA, 225 bp, Unknown
  Encodes 16S rRNA from Oscillibacter
agagtttgatcatggctcaggacgaacgctggcggcgtgcttaacacatgcaagtcgaacggagtgcccttgaaagaggtttcggccaatggaaggggttacttagtggcggactggtgagtaacgcgtgaggaacctgcctttcagagggggacaacagctggaaacggctgctaataccgcatgacacattcgggcggcatcgcctggatgtcaaagatttat

SEQ ID NO: 372 - DNA, 225 bp, Unknown
  Encodes 16S rRNA from Butyricimonas
agagtttgatcctggctcaggatgaacgctagcgacaggcttaacacatgcaagtcgaggggcagcacggcggtggcaacactgctggtggcgaccggcgcactggtgagtaacacgtatgcaacctgccccgcacagggggataatccgcggaaacgcggtctaataccccgtagaacctttggtcgcatgattagaggtggaaagctccggtggtgcgggatg

SEQ ID NO: 373 - DNA, 225 bp, Unknown
  Encodes 16S rRNA from Dethiosulfovibrio
agagtttgatcatggctcaggatgaacgctggcggcgtgcataacacattcaagtcgaacgaagcgccgggacggaacccttcggggggaagacccgatgacttagtggcggacgggtgagtaacgcgtgagcaacctgcctgcgatagagggataacaccgggaaaccggtgctaataccacatgaggcagagaggtcacatggtctttctgttaaagatttat

SEQ ID NO: 374 - DNA, 225 bp, Unknown
  Encodes 16S rRNA from Pseudoflavonifractor
agagtttgatcatggctcaggatgaacgctggcggcgcgcctaacacatgcaagtcgaacggcgaagtcccttcgggggcggaacagtggcggacgggtgagtaacgcgtgagtaacctgcccttacgagcggaatagcgtcgggaaactgacggtaataccgcatgaagcttgaccccggcatcggggagaagccaaagatttatcgcgtaaggatggactcgc

SEQ ID NO: 375 - DNA, 225 bp, Unknown
  Encodes 16S rRNA from Clostridium IV
agagtttgatcatggctcaggatgaacgctggcggcgtgcctaacacatgcaagtcgaacggagctttttatgaacaagacttcggtcaagtaaattctaagcttagtggcggacgggtgagtaacgcgtgagtaacctgcctttcagagggggataacgttcggaaacgaacgctaataccgcataacatagcggaaccgcatgattctgctatcaaagatttt

SEQ ID NO: 376 - DNA, 225 bp, Unknown
  Encodes 16S rRNA from Anaeroplasma
agagtttgatcatggctcaggattaacgctggcggcgtgcctaatacatgcaagtcgaatggttagcttgctaaccatggcgaacgggtgagtaacacgtaggcaacctgtcttacagacgaggataaccgttggaaacgacggataatactggatagtacatcacaatgggcatccatagatgtttaaaggagcaatccactgtaagaggggcctgcggcgcat

SEQ ID NO: 377 - DNA, 225 bp, Unknown
  Encodes 16S rRNA from Oscillibacter
agagtttgatcatggctcaggatgaacgctggcggcgtgcctaacacatgcaagtcgaacggagcttattggaaggagacttcggtcaacggaagataagcttagtggcggacgggtgagtaacgcgtgagcaacctgcctcagagtgggggacaacagctggaaacggctgctaataccgcataacattgcctgaaggcatcttcgggtaatcaaagcttaatg

SEQ ID NO: 378 - DNA, 225 bp, Unknown
  Encodes 16S rRNA from Herbiconiux
agagtttgatcatggctcaggacgaacgctggcggcatgcctaacacatgcaagtcgaacggacggaagtagcaatactgaagttagtggcgaacgggtgagtaacacgtgagcaacctgccctatacactgggatagcagttggaaacgactgataataccggataagaccacgctgtcgcatgacagaggggtcaaagcgctttagcggtatgggatgggctc

SEQ ID NO: 379 - DNA, 225 bp, Unknown
  Encodes 16S rRNA from Eubacterium
agagtttgatcatggctcaggattaacgctggcggcgtgcctaacacatgcaagtcgagcgagaagcagtgaagggagtcttcggacaaacggaactgtggacagcggcggacgggtgagtaacgcgtgggcaacctgcccctttccggaggatagccaagggaaactttgaataatactccataaagcagagatgtcgcatggcaattctgccaaagatttatc

SEQ ID NO: 380 - DNA, 225 bp, Unknown
  Encodes 16S rRNA from unknown taxa
agagtttgatcatggctcaggacgaacgcttgcgacgtgcctaagaaatgcaagtcgagcgatgacgggggcttcggctccttgattagcggcgaacggtcgcgtaacacgtaagcaatctgccccaaagtttgggatagccatccgaaaggatgattaataccggatgtggaatatatatcgcatgttatatattctaaagcagcgatgcgctttgggatgagc

SEQ ID NO: 381 - DNA, 225 bp, Unknown
  Encodes 16S rRNA from Selenomonas
agagtttgatcctggctcaggacgaacgctggcggcgtgcttaacacatgcaagtcgaacgagacgattttaagcttgcttagatgagtcgagtggcaaacgggtgagtaacgcgtagacaacctgccgcaaagatggggacaacagtccgaaaggactgctaataccgaatgttgtcaagtttccgcatgggagcttgattaaagatggcctctacttgtaagc

SEQ ID NO: 382 - DNA, 225 bp, Unknown
  Encodes 16S rRNA from Clostridium IV
agagtttgatcatggctcaggacgaacgctggcggcgtgcttaacacatgcaagtcgaacgaagcttgatttaagatttcttcggaatgattaatgatatgacttagtggcggacgggtgagtaacgcgtgaggaacctgcctttcagagggggacaacatttggaaacgaatgctaataccgcataacgcatttaagggacatcccatagatgccaaagattta

SEQ ID NO: 383 - DNA, 225 bp, Unknown
  Encodes 16S rRNA from Mogibacterium
agagtttgatcatggctcaggatgaacgctggcggcgtgcctaatacatgcaagtcgagcgagaatctcttcagaagcgttttcggacaattccgaggagaggaaagcggcggacgggtgagtaacgcgtaggcaacctgcccttagcagagggatagccattggaaacgatgattaaaacctcataatgctgttgtgacacatgtcagagcagccaaagattta

SEQ ID NO: 384 - DNA, 225 bp, Unknown
  Encodes 16S rRNA from Clostridium IV
agagtttgatcatggctcaggatgaacgctggcggcgtgcctaacacattcaagtcgaacggagaagggggcttcggtcccctgatcagtggcggacgggtgagtaacgcgtgagcaacctgcctttgtgtggggaataacacagggaaacttgtgctaataccgcataacgcatcgacgtagcattacgatgatgccaaagatttattgcacgaagatgggctc

SEQ ID NO: 385 - DNA, 225 bp, Unknown
  Encodes 16S rRNA from Roseburia
agagtttgatcatggctcaggatgaacgctggcggcgtgcttaacacatgcaagtcgaacgaagcgatcctttgtgaagcgaagaagcttgcttcctagtggaactgtggattgacttagtggcggacgggtgagtaacgcgtgggtaacctgcctcacacagggggataacagttagaaatgactgctaataccgcataaaatggcagtgtcgcatgacacaac

SEQ ID NO: 386 - DNA, 225 bp, Unknown
  Encodes 16S rRNA from Anaerovibrio
agagtttgatcatggctcaggacgaacgctggcggcgtgcttaacacatgcaagtcgaacggggcgaagaggagcttgctcttcctagcctagtggcaaacgggtgagtaacgcgtaggcaacctgcccttcagatggggacaacatttcgaaaggaatgctaataccgaatgacgtgcattggtcgcatgaccgatgtaccaaaggccgggcaaccggtcactg

SEQ ID NO: 387 - DNA, 225 bp, Unknown
  Encodes 16S rRNA from Clostridium III
agagtttgatcctggctcaggacgaacgctggcggtatgcttaatacatgcaagtcgaacggagctcagcggaagcttgcttctgcgaaagcttagtggcggacgggtgagtaacgcgtgagtaacctgccttaaagagggggataacacagagaaatctgtgctaataccgcataatgcagcgaagccgcatggctatgctgccaaaggtcagccgctttaaga

SEQ ID NO: 388 - DNA, 225 bp, Unknown
  Encodes 16S rRNA from Saccharofermentans
agagtttgatcatggctcaggacgaacgctggcggcgtgcctaacacatgcaagtcgagcggagatgaggagaagcttgcttcgagacatcttagcggcggacgggtgagtaacgcgtgagcaacctgtcctctgcagggggataagacagcgaaagttgttctaataccgcatgagaccacaacgtcacatggcgaaggggtcaaaggagaaatccggcagagg

SEQ ID NO: 389 - DNA, 225 bp, Unknown
  Encodes 16S rRNA from Saccharofermentans
agagtttgatcatggctcaggatgaacgctggcggcgtgcctaacacatgcaagtcgaacggacgatgaagctcagcttgctgagattcaaagttagtggcggactggtgagtaatgtatgagcaacctgcctttcagaggggaataacacaatgaaagttgtgctaataccgcataatattgtaatattgcatgataatacaatcaaaggagtgatccgctgag

SEQ ID NO: 390 - DNA, 225 bp, Unknown
  Encodes 16S rRNA from Prevotella
agagtttgatcatggctcaggatgaacgctagctacaggcttaacacatgcaagtcgaggggcagcatgggagttgcttgcaattcccgatggcgaccggcgcacgggtgagtaacgcgtatccaaccttcccttaactccggaatagcccgctgaaaggcggattaatgccggatgcggtccagcgagggcatctgacccggaccaaaggattcgtccggttaa

SEQ ID NO: 391 - DNA, 225 bp, Unknown
  Encodes 16S rRNA from Clostridium XlVa
agagtttgatcatggctcaggatgaacgctggcggcgtgcctaacacatgcaagtcgaacggaaatgttctgatgaagtcttcggatagattcattacattttagtggcggacgggtgagtaacacgtgggtaacctgccctgtaccgggggataacacttagaaataggtgataataccgcataagcgcacactgaggcatctcagagtgtgaaaaactccggt

SEQ ID NO: 392 - DNA, 225 bp, Unknown
  Encodes 16S rRNA from Robinsoniella
agagtttgatcctggctcaggatgaacgctagctacaggcttaacacatgcaagtcgagcgatgaataaaccgacaaggtttcggccaaggaagtttattcagagcggcggatgggtgaggaacgcgtggggaacctgcctttcaccgggggataccagctggaaacggctgttaataccgcatatgctcacagtgccgcatggcacagggaggaaaactccggt

SEQ ID NO: 393 - DNA, 225 bp, Unknown
  Encodes 16S rRNA from Brevundimonas
agagtttgatcatggctcaggacgaacgctggcggtgtgcctcatacatgcaagtcgaacgataaggcttcttcggaagtacataagtggcggacgggtgagtacaacataggaaatctgccttagggtgggggacaacagagggaaactcctgctaataccccatatgagctaacttgaaatagttatcttgaaaactccggtgccctaagatgagcctgtgcc

SEQ ID NO: 394 - DNA, 225 bp, Unknown
  Encodes 16S rRNA from Anaerotruncus
agagtttgatcatggctcaggacgaacgctggcggcgcgcttaacacatgcaagtcgaacggagtgtgcttttgaaggtccttcgggaacggatgttgtacacttagtggcggacgggtgagtaacgcgtgagcaacctgcctttcagagggggataacacaacgaaagctgtgctaataccgcatgacattgcgacaccgcatggtgatgcaatcaaaggagca

SEQ ID NO: 395 - DNA, 225 bp, Unknown
  Encodes 16S rRNA from Victivallis
agagtttgatcatggctcagaacgaacgctggcggcatggattaggcatgcaagtcgaacgaagcagcaatgcttagtggcgcaagggtgaggaacacgtgagtgacctacccgcaagtttggaacagctcctggaaacgggaattaataccggatgtgatcgatgaactgcatggtttattgattaaagcagcaatgcgcttgcggatgggctcgcgtcccatt

SEQ ID NO: 396 - DNA, 225 bp, Unknown
  Encodes 16S rRNA from Bacteroides
agagtttgatcctggctcaggatgaacgctagcgacaggcctaacacatgcaagtcgaggggcagcatggttgaagcttgcttcaactgatggcgaccggcgcacgggtgcgtaacgggtgtgcaatttgtcctataccaagggatagcccgctgaaaggcggattaatactttatgtgagtagggggggcatcctctttatttgaaacgtgagggtataggttg

SEQ ID NO: 397 - DNA, 225 bp, Unknown
  Encodes 16S rRNA from Clostridium XlVb
agagtttgatcatggctcaggacgaacgctggcggcgtgcttaatacatgcaagtcgaacgaggtatagcaatataccgagtggcgaacgggtgagtaacacgtgagcaacctgccctatacagggggacaacagctggaaacggctgctaataccgcataagaccacagcaccgcatggtgcaggggtaaaaggctacggtcggtataggatgggctcgcgtac

SEQ ID NO: 398 - DNA, 225 bp, Unknown
  Encodes 16S rRNA from Prevotella
agagtttgatcctggctcaggatgaacgctagctacaggcttaacacatgcaagtcgaggggcatcatgaagtttgcttgcaagctttgatggcgaccggcgcacgggtgcgtaacgcgtatccaatctaccagttactcgggtatagccttgcgaaagtaagattaatccccgatgagtatagttactgcatggtgattatataaaagatttatcggtagctga

SEQ ID NO: 399 - DNA, 225 bp, Unknown
  Encodes 16S rRNA from Ruminococcus
agagtttgatcatggctcaggacgaacgctggcggcacgcttaacacatgcaagtcgaacgagcgaagagagcttgctctccaagctagtggcggacgggtgagtaacacgtgagcaatctgcctttgggtgggggataccagttggaaacgactgttaataccgcataaaatagtaagaccgcatgatcatactatcaaagattcattgcctgaagatgagctc

SEQ ID NO: 400 - DNA, 225 bp, Unknown
  Encodes 16S rRNA from Pelobacter
agagtttgatcctggctcagaattaacgctggcggcgtgcctaacacatgcaagtcgagcgaattcttacagagcatcgtaagagttagcggcaaacgggtgagtaacacatgggaaacctccctcgaaatggggaatatcttcgtgaaaacggagttaataccgcataagaccacagtttggcatcagacaggggtcaaagcagcaatgcgtttcgagatggtc

SEQ ID NO: 401 - DNA, 225 bp, Unknown
  Encodes 16S rRNA from Clostridium XlVa
agagtttgatcatggctcaggatgaacgctggcggcgtgcttaacacatgcaagtcgaacgaatttcttacggatcgcgacttcggtcaagagaagtttgaagtgagtggcggacgggtgagtaacgcgtgggtaacctgccttacaccgggggataacagagggaaacttctgctaataccgcataagaccacagtgccgcatggtacagaggtaaaagttccg

SEQ ID NO: 402 - DNA, 225 bp, Unknown
  Encodes 16S rRNA from Clostridium XlVa
agagtttgatcatggctcaggatgaacgctggcggcgtgcctaacacatgcaagtcgagcggagataagttgaagcctagcgattcttatcttagcggcggatgggtgagtaacacgtgggtaacctgccctgcactggggaataacagctggaaacggctgttaatgccgcatatgcgcacggagccgcatggctttgggcggaaagatttatcggtgcaggat

SEQ ID NO: 403 - DNA, 225 bp, Unknown
  Encodes 16S rRNA from Clostridium XlVb
agagtttgatcatggctcaggatgaacgctggcggcgtgcctaacacatgcaagtcgagcgaagcataggtgcttgcacttatgacttagcggcggacgggtgagtaacgcgtgggtaacctgccctatacagaggaataacagttagaaatgactgctaatgcctcataagccgacgaaatggcatctttttgtcggaaaagatttatcggtataggagggacc

SEQ ID NO: 404 - DNA, 225 bp, Unknown
  Encodes 16S rRNA from Coprococcus
agagtttgatcatggctcaggatgaacgctggcggcgtgcctaacacatgcaagtcgaacgaagtgtcaattcttcggagctgacacttagtggcggacgggtgagtaacgcgtgggtaacctgcctcatacagggggatagcagttggaaacgactgataataccgcataagcgcacagcatcgcatgatgcagtgtgaaaaactccggtggtatgagatggac

SEQ ID NO: 405 - DNA, 225 bp, Unknown
  Encodes 16S rRNA from Clostridium IV
agagtttgatcatggctcaggacgaacgctggcggcgtgcctaacacatgcaagtcgaacggagttattcgaaagcttgcttttggataacttagtggcggacgggtgagtaacgcgtgagtaacctgcctttcagagggggataacgttctgaaaagaacgctaataccgcataatgtataattgtcgcatggcagcgataccaaaggagcaatccgctgaaag

SEQ ID NO: 406 - DNA, 225 bp, Unknown
  Encodes 16S rRNA from Clostridium IV
agagtttgatcctggctcaggatgaacgctggcggcgtgcctaacacatgcaagtcgaacggaacttttaaggaacaagacttcggtcaagtgatatttaagtttagtggcggacgggtgagtaacgcgtgagcaacctgcctctcagagggggataacgtccggaaacggacgctaataccgcataacatggagagatcgcatgatcattccatcaaagatttt

SEQ ID NO: 407 - DNA, 225 bp, Unknown
  Encodes 16S rRNA from Coprococcus
agagtttgatcatggctcaggatgaacgctggcggcgtgcttaacacatgcaagtcgaacgaagcacttacgattgactggagagcttgctcaaagggattttgtttgtgacttagtggcggacgggtgagtaacgcgtgggtaacctgcctcatacagggggataacagttggaaacgactgttaataccgcataagcgcacagtaccgcatggtacagtgtga

SEQ ID NO: 408 - DNA, 225 bp, Unknown
  Encodes 16S rRNA from Victivallis
agagtttgatcctggctcagaacgaacgctggcggcatggattaggcatgcaagtcgaacgaagcagcaatgcttagtggcggaagggtgaggaacgcgtgagcaacctgcccccaagttgggaataacagttggaaacgactgctaataccgaatgtggcttttggaccgcatggtttgatggctaaagatttattgcttggggatgggctcgcgtcccattag

SEQ ID NO: 409 - DNA, 225 bp, Unknown
  Encodes 16S rRNA from Clostridium III
agagtttgatcatggctcaggacgaacgctggcggcgtgcctaacacatgcaagtcgagcggagcttaagaagtcagaagttttcggacggaagacattttaagcttagcggcggacgggtgagtaacgcgtgggcaatctgcccttcacagggggataacacagggaaacttgtgctaataccgcataagatcgtataacggcatcgttaagcgaccaaaggag

SEQ ID NO: 410 - DNA, 225 bp, Unknown
  Encodes 16S rRNA from Anaerovibrio
agagtttgatcctggctcaggacgaacgctggcggcgtgcttaacacatgcaagtcgaacggggcgaagaggagcttgctcttcctagcctagtggcaaacgggtgagtaacgcgtaggcaacctgcccttcagatggggacaacatttcgaaaggaatgctaataccgaatgacgtgcattggtcgcatgaccgatgtaccaaaggccgggcaaccggtcactg

SEQ ID NO: 411 - DNA, 225 bp, Unknown
  Encodes 16S rRNA from Anaerovorax
agagtttgatcctggctcaggatgaacgctggcggcgtgcctaacacatgcaagtcgagcgagaaatcatcagaatgaaacttcggtagatttcagatgatggaaagcggcggacgggtgagtaacgcgtaggcaacctgccctttgcagagggatagccatgggaaactgtgattaaaacctcataacaccattctatcacatgttagaacggtcaaagattta

SEQ ID NO: 412 - DNA, 225 bp, Unknown
  Encodes 16S rRNA from Proteiniclasticum
agagtttgatcatggctcaggacgaacgctggcggcgtgcttaacacatgcaagtcgaacgagggatgaataaagcttgctttgttcatttcgagtggcggacgggtgagtaacgcgtgaggaacctggcttttgcagggggatagcgtcccgaaagagacggtaataccgcataagaccacgctaccgcatggtaaaggggtcaaaggagagatccggcagaag

SEQ ID NO: 413 - DNA, 225 bp, Unknown
  Encodes 16S rRNA from Anaerovorax
agagtttgatcatggctcaggatgaacgctggcggcgtgcctaacacatgcaagtcgagcgagaaacttttgactgacgcttcggttgatttcaaaagcggaaagcggcggacgggtgagtaacgcgtaggcaacctgccctttgcagagggatagcctcgggaaaccgggattaaaacctcataacaccggagtacctcatggtgcaccggtcaaagatttatc

SEQ ID NO: 414 - DNA, 225 bp, Unknown
  Encodes 16S rRNA from Selenomonas
agagtttgatcctggctcaggacgaacgctggcggcgtgcttaacacatgcaagtcgaacgaggtgattgaaagcttgcttttgagaaccgagtggcaaacgggtgagtaacgcgtagacaacctgccgcaaagatggggacaacagtccgaaaggactgctaataccgaatgttgtgcaacttccgcatgggagatgcattaaagatggcctctacttgtaagc

SEQ ID NO: 415 - DNA, 225 bp, Unknown
  Encodes 16S rRNA from Hydrogenoanaerobacterium
agagtttgatcatggctcaggacgaacgctggcggcacgcttaacacatgcaagtcgaacggaacttgggagcttgctttcaagtttagtggcggacgggtgagtaacacgtgagcaacctgcctttcggcggggaataatgattggaaacgatcactaataccccataaaataggtttatcgcatgatagatttatcaaagattcatcaccgaaagatgggctc

SEQ ID NO: 416 - DNA, 225 bp, Unknown
  Encodes 16S rRNA from Acetanaerobacterium
agagtttgatcatggctcaggacgaacgctggcggcgcgcctaacacatgcaagtcgaacggacgaggatccttcgggatccgagttagtggcgaacgggtgagtaacacgtgaggaacctacctttcagagggggataacacttagaaataggtgctaataccgcataagaccacgaccgggcatccggatgaggtcaaaggagcaatccgctgagagacggcc

SEQ ID NO: 417 - DNA, 225 bp, Unknown
  Encodes 16S rRNA from Clostridium XlVa
agagtttgatcctggctcaggatgaacgctggcggcgtgcttaacacatgcaagtcgaacgaagcatgagctgaaattttcggatggatgcccatgacttagtggcggacgggtgagtaacgcgtgggtaacctgcctcatgcagggggacaacagctggaaacggctgctaataccgcataagaccccgtgagcgcatgctcaagaggtaaaagatttatcggc

SEQ ID NO: 418 - DNA, 225 bp, Unknown
  Encodes 16S rRNA from Asaccharobacter
agagtttgatcatggctcaggatgaacgctggcggcgtgcttaacacatgcaagtcgaacgattaaaccggcttcggccggatatagagtggcgaacgggtgagtaacacgtgaccaacctgccccatacttcgggataactcagggaaacttgtgctaataccggatactccgatttgatcgcatggtcttttcgggaaagcctttacggtatgggatggggtc

SEQ ID NO: 419 - DNA, 225 bp, Unknown
  Encodes 16S rRNA from Clostridium XlVa
agagtttgatcatggctcaggatgaacgctggcggcgtgcttaatacatgcaagtcgaacggagatgtccacctgatgaagcagagtgcttgcacaaagcagaatcaaccggatatcttagtggcggacgggtgagtaacgcgtgggtaacctgcctcatactggggaataacagccagaaatgactgctaataccgcataagcgcacagtaccgcatgatacag

SEQ ID NO: 420 - DNA, 225 bp, Unknown
  Encodes 16S rRNA from Lachnospiracea incertae sedis
agagtttgatcctggctcaggatgaacgctggcggcgtgcctaacacatgcaagtcgagcggagtaagacaccggatgaagattcgtctgaatccaccgtcttacttagcggcggatgggtgagtaacgcgtggacaacctgcccttcactgggggataacaaccggaaacgggtgctaataccgcatgggcgcgaacgaccgcatgatcgatcgcgtaaagatt

SEQ ID NO: 421 - DNA, 225 bp, Unknown
  Encodes 16S rRNA from Saccharofermentans
agagtttgatcatggctcaggatgaacgctggcggcgtgcctaacacattcaagtcgaacggagatatacggaagcttgcttttgtatattttagtggcggacgggtgagtaatgcatgagcaacctgccttgaagagggggataacacagagaaatttgtgctaataccgcgtaatctgccgaagcggcatcgcgttggcaggaaaggagcgatccgctttaag

SEQ ID NO: 422 - DNA, 225 bp, Unknown
  Encodes 16S rRNA from Prevotella
agagtttgatcatggctcaggatgaacgctagctacaggcttaacacatgcaagtcgaggggcagcatggcggtggcttgccaccgccgatggcgaccggcgcacgggtgagtaacgcgtatccaacctgcccgcaaccgcggaatagcccgccgaaaggcggattaatgccgcatgagctcgcgcgaggacatctgatcgcgagcaaaggtttttccggttgcg

SEQ ID NO: 423 - DNA, 225 bp, Unknown
  Encodes 16S rRNA from Anaeroplasma
agagtttgatcatggctcaggattaacgctggcggcgtgcctaatacatgcaagtcgaatggttagcttgctaaccatggcgaacgggtgagtaacacgtaggcaacctgtctataagacgaggataaccattggaaacgatggataatactggataggatattgaggggcatcccttaatatttaaagatttatcactaatagaggggcctgcggcgcattagc

SEQ ID NO: 424 - DNA, 225 bp, Unknown
  Encodes 16S rRNA from Spirochaeta
agagtttgatcctggctcagaacgaacgctggcggcgcgtcttaaccatgcaagtcggacggcaaggcgggagcttgctcctgccctagagtggcggactggtgagtaacacgtgggtgacgaaccctgctgactgggatagccgctagaaatagcggataataccggatacggccgtatgtatcagaagcatacggggaaagggagcttaggctccgcaggagg

SEQ ID NO: 425 - DNA, 225 bp, Unknown
  Encodes 16S rRNA from Alkaliphilus
agagtttgatcatggctcaggatgaacgctggcggcgtgcctaacacatgcaagtcgagcgggaaatctttgaatgaaacttcggtcgaatgatgagatggatagcggcggacgggtgagtaacgcgtaggtaagctgccccatgcacagggatagcctagggaaacttggattaatacctgatgacgctgcgaagtcacatgtctttgcagccaaagatctatc

SEQ ID NO: 426 - DNA, 225 bp, Unknown
  Encodes 16S rRNA from Paraprevotella
agagtttgatcatggctcaggatgaacgctagctacaggcttaacacatgcaagtcgaggggcagcatgtcgtgtgcttgcacacgatgatggcgaccggcgcacgggtgagtaacgcgtatccaacctgcccatgactccgggatagcccgctgaaaagcggattaacaccggatggggtcgaacgaggacatctgatttcgaccaaagctttttgcggtcatg

SEQ ID NO: 427 - DNA, 225 bp, Unknown
  Encodes 16S rRNA from Hippea
agagtttgatcatggctcagagttaacgctggcggcgtgcctaacacatgcaagtcgagcgaatttctacagagcatcgtagagattagcggcaaacgggtgagtaacacatgggaaaccttccttagaatggggaatatctccgtgaaaacggagctaataccgcataagaccacagattggcatcaaacaggggtaaaagcagcaatgcgttctaagatggtc

SEQ ID NO: 428 - DNA, 225 bp, Unknown
  Encodes 16S rRNA from Prevotella
agagtttgatcatggctcaggatgaacgctagctacaggcttaacacatgcaagtcgaggggcagcatgaacttagcttgctaagtttgatggcgaccggcgcacgggtgagtaacgcgtatccgaccttccctttgctcggggatagcccagtgaaaactggattaagacccgatgtagtccagctggcgcatgttatctggactaaagatttatcggcagagg

SEQ ID NO: 429 - DNA, 225 bp, Unknown
  Encodes 16S rRNA from Prevotella
agagtttgatcatggctcaggatgaacgctagctacaggcttaacacatgcaagtcgaggggcatcatgcaggttgcttgcaacctgtgatggcgaccggcgcacgggtgcgtaacgcgtatccaaccttccccgcagtagggttcagcccgttgaaagacggattaatcccctatgttgtccattgagggcctctgatttggacgaaagatttatcgctgcggg

SEQ ID NO: 430 - DNA, 225 bp, Unknown
  Encodes 16S rRNA from Hydrogenoanaerobacterium
agagtttgatcatggctcaggacgaacgctggcggcgcgcctaacacatgcaagtcgaacgggactagtgaccggagggtagaaggatctatcttgcgatcactagttcagtggcggacgggtgagtaaagcatgagcaacctggctaatagagggggatagcttttggaaacagaagataataccgcatgaatcagagatttcgcatgaagtttttggaaaagg

SEQ ID NO: 431 - DNA, 225 bp, Unknown
  Encodes 16S rRNA from Clostridium sensu stricto
agagtttgatcatggctcaggacgaacgctggcggcatgcttaacacatgcaagtcgaacggactgattccttcgggatgaaagttagtggcgaacgggtgagtaatgtatgagcaacctgcctctatcaacgggataacagttggaaacgactgctaatacggtataagaccacggcaccgcatgatgctgcggtaaaagatttttcggatagagatgggctca

SEQ ID NO: 432 - DNA, 225 bp, Unknown
  Encodes 16S rRNA from Paraeggerthella
agagtttgatcatggctcaggatgaacgctggcggcgtgcctaacacatgcaagtcgaacggagaacccgccctcgggcggttatgaagtggcgaacgggtgagtaacacgtgaccaacctgccccgcgctcagggacagcctcgggaaaccgggattaatacctgatgcgcccccgcccccgcatgggggaggggggaaagcccaggcggcgcgggatggggtc

SEQ ID NO: 433 - DNA, 225 bp, Unknown
  Encodes 16S rRNA from Clostridium XlVa
agagtttgatcatggctcaggatgaacgctggcggcgtgcttaacacatgcaagtcgaacgaggttgttagaatgaagcagcttgctgtgaatttctagccaccgagtggcggacgggtgagtaacgcgtgggtaacctgccctacagtgggggacaacagttggaaacgactgctaataccgcataagcgcacagtatcgcatgatacagtgtgaaaaactccg

SEQ ID NO: 434 - DNA, 225 bp, Unknown
  Encodes 16S rRNA from Clostridium XlVa
agagtttgatcatggctcaggatgaacgctggcggcgtgcctaacacatgcaggtcgaacgggacctatgtagatcaagacttcggtcaagtgaaatttaggtttagtggcggacgggtgagtaacgcgtgagcaatctgccgtatgcagggggacaacagagggaaacttctgctaataccgcataagcgcacggtatcgcatggtacagtgtgaaaagctccg

SEQ ID NO: 435 - DNA, 225 bp, Unknown
  Encodes 16S rRNA from Clostridium IV
agagtttgatcatggctcaggacgaacgctggcggcgtgcctaacacatgcaagtcgaacggaaatttttcggcagagattcgtcgaagcttaagaattttagtggcggacgggtgagtaacgcgtgagtaacctgccgatgagagtggaataacgttctgaaaagaacgctaataccgcataatatattggagccgcatgactctgatatcaaagattttatcg

SEQ ID NO: 436 - DNA, 225 bp, Unknown
  Encodes 16S rRNA from Clostridium XlVa
agagtttgatcatggctcaggatgaacgctggcggcgtgcctaacacatgcaagtcgaacgaggctctgcgaaatgaagattcgtctgaatttcaaggatgtccgagtggcggatgggtgagtaacgcgtggagaacctgccctatgctgggggataacagctggaaacggttgacaataccgcataagcttctttggtcgcatgaccttggaaggaaagattta

SEQ ID NO: 437 - DNA, 225 bp, Unknown
  Encodes 16S rRNA from Adhaeribacter
agagtttgatcatggctcaggatgaacgctggcggcaggcttaatacatgcaagtcgaacggtaaggtctgaagtagcaatactaaagatacacgagtggcgcacgggtgcgtaacgcgtatgtaatctacccttaaccggaacaaaacagttggaaacgactgctaatattccatagtcattagttaaggcatcttaaagaatgtaaagatttattggttaagg

SEQ ID NO: 438 - DNA, 225 bp, Unknown
  Encodes 16S rRNA from Syntrophococcus
agagtttgatcatggctcaggatgaacgctggcggcgtgcctaacacatgcaagtcgaacgaggctcttttctcagatgtttcgactgaagagagaagatcaccgagtggcggatgggtgagtaacgcgtggagaacctgcccttatcagggggataacaactggaaacggttgacaataccgcatatagtgcttgatcgcatgttcttgcacggaaagatttat

SEQ ID NO: 439 - DNA, 225 bp, Unknown
  Encodes 16S rRNA from Clostridium sensu stricto
agagtttgatcatggctcaggacgaacgctggcggcgtgcttaacacatgcaagtcgaacgaggcaagttccttcggggacttaccgagtggcggacgggtgagtaacgcgtgagcaatctgtcccagacagggggataacaactggaaacagttgctaataccgcataagaccacggagccgcatggctttgaggtaaaaggagcgatccggtttggggtgagt

SEQ ID NO: 440 - DNA, 225 bp, Unknown
  Encodes 16S rRNA from Saccharofermentans
agagtttgatcatggctcaggatgaacgctggcggcgtgcataacacattcaagtcgaacggactgatttgatagcttgctattgatgaaagttagtggcggacgggtgagtaacgcgtgagcaacctgcccctatgtgcgggataacgtttggaaacggacgctaataccgcataatccaattggatcgcatggtctggttggcaaagatttattgcataggga

SEQ ID NO: 441 - DNA, 225 bp, Unknown
  Encodes 16S rRNA from Clostridium IV
agagtttgatcatggctcaggacgaacgctggcggcgtgcctaacacatgcaagtcgaacggagttattcgagatgaagttttcggatggaattttggataacttagtggcggacgggtgagtaacgcgtgagtaacctgcccataagagggggataacgttctgaaaagaacgctaataccgcatgacatatttggttcgcatgaatcgaatatcaaaggagca

SEQ ID NO: 442 - DNA, 225 bp, Unknown
  Encodes 16S rRNA from Clostridium IV
agagtttgatcatggctcaggatgaacgctggcggcgtgcttaacacatgcaagtcgaacgaggttagcggcttcggctgttaaccgagtggcggacgggtgagtaacgcgtgaacaatctgtcctgcaaagggggataccaactggaaacagttgctaataccgcataagaccacggcctcgcatggggctgaggtaaaagcagcgatgcgatgcagggtgagt

SEQ ID NO: 443 - DNA, 225 bp, Unknown
  Encodes 16S rRNA from Clostridium sensu stricto
agagtttgatcctggctcaggacgaacgctggcggcatgcctaacacatgcaagtcgaacgagatagcaatatctagtggcgaacgggtgagtaacacgtgagcaatctgccccatatacagggataacagttagaaatgactgctaataccggataagaccacagcctggcatcgggcaggggtcaaagcgatttagcgatatgggatgagctcgcgtccaatt

SEQ ID NO: 444 - DNA, 225 bp, Unknown
  Encodes 16S rRNA from Coraliomargarita
agagtttgatcctggctcagagtgaacgctggcggcgtggctaagacatgcaagtcgagcgagaaggtgccttcgggtgccggaaagcggcaaacgggtgcgtaacacgtaagtaacctgcccttaagacgggaatagttcgatgaaaattgagataatgcccgatatcaacttctttcgcatggaagaggtttgaaaggtttgtgatgacgcttaaggaggggc

SEQ ID NO: 445 - DNA, 185 bp, Unknown
  Encodes 16S rRNA from Sharpea
agagtttgatcatggctcaggatgaacgctggcggcgtgcttaacacatgcaagttgaacgaggaaggccttcgggtcgtaaagttctgttgcgaaggaagaacgccggagggaggaaatggcctccgggtgacggtacttcgcgagaaagccacggctaactacgtgccagcagccgcggtaat

SEQ ID NO: 446 - DNA, 225 bp, Unknown
  Encodes 16S rRNA from Clostridium IV
agagtttgatcatggctcaggattaacgctggcggcgtgcataacacattcaagtcgaacggagtattgctttcgggtgatactcagtggcggacgggtgagtaacgcgtgagcaatctgccccttattgcgggataacagagagaaatttctgctaatacggcataacgcatcggtatcgcatggtacgggtgccaaagatttatcgatgagggatgagctcgc

SEQ ID NO: 447 - DNA, 225 bp, Unknown
  Encodes 16S rRNA from Anaerovorax
agagtttgatcctggctcaggatgaacgctggcggcgtgcctaacacatgcaagtcgagcgagaaacctgtaattgacgcttcggttgattttacaggcggaaagcggcggacgggtgagtaacgcgtaggcaacctgccctttgcacagggatagcctcgggaaaccgggattaaaacctgatgataccgagacaccacatggtgttccggccaaagatttatc

SEQ ID NO: 448 - DNA, 225 bp, Unknown
  Encodes 16S rRNA from Blautia
agagtttgatcatggctcaggatgaacgctggcggcgtgcctaacacatgcaagtcgaacgggtctaaagttttggaggcttcggccaaagaggctctagattagtggcggacgggtgagtaacgcgtggagaacctgccctgtactgggggataacagtgagaaatcactgctaataccgcataagcgcacgaggccgcatggccctgtgtgaaaaactccggt

SEQ ID NO: 449 - DNA, 225 bp, Unknown
  Encodes 16S rRNA from Clostridium XlVa
agagtttgatcatggctcaggatgaacgctggcggcgtgcctaacacatgcaagtcgaacgagcgagagatgaaacctagtgaatttcgagcgagtggcggacgggtgagtaacgcgtgggtaacctgccttacagagggggataacagtttgaaaagactgctaataccgcataagcacacagtaccgcatggtacagggtgaaaagatttatcactgtaagat

SEQ ID NO: 450 - DNA, 225 bp, Unknown
  Encodes 16S rRNA from Clostridium IV
agagtttgatcatggctcaggatgaacgctggcggcgtgcataacacattcaagtcgaacgaagcaccggcgaggaagtcttcggatggaattgcttttgacttagtggcggacgggtgagtaacgcgtgagcaaccttcctgtttgtgagggataacacagggaaacttgtgctaataccgcatgacgcatgggaatcgcatggtttcgatgccaaagatttat

SEQ ID NO: 451 - DNA, 225 bp, Unknown
  Encodes 16S rRNA from Anaerovorax
agagtttgatcatggctcaggatgaacgctggcggcgtgcctaacacatgcaagtcgagcgggagtatcgcaaacagagattcgtcaaagtgagcgatatgagagcggcggacgggtgagtaacgcgtaggtaacctaccttaagctgagggataacccagggaaacttgggataataccacataacgcggtgaagtcacatggctttaccgccaaagatttatc

SEQ ID NO: 452 - DNA, 225 bp, Unknown
  Encodes 16S rRNA from Coraliomargarita
agagtttgatcctggctcagagtgaacgctggcggcgtggctaagacatgcaagttgagcgagaatataccttcgggtatagggaagcggcaaacgggtgagtaacacgtaagtaacctacccttgagactgggatagctcagcgaaagttgaggtaataccggatgccaaccattaatgcatgttaatggattgaaagggatgagacgatgctcaaggaggggc

SEQ ID NO: 453 - DNA, 225 bp, Unknown
  Encodes 16S rRNA from Lachnospiracea incertae sedis
agagtttgatcctggctcaggatgaacgctggcggcgtgcttaacacatgcaagtcgaacggaacatttcgcccgatgattgagaaagcttgcttcctcctgattcaactgaaatgtttagtggcggacgggtgagtaacgcgtgggtaacctaccttacacagggggataacagttagaaatgactgctaataccgcataagcgcacagtaccgcatggtacag

SEQ ID NO: 454 - DNA, 225 bp, Unknown
  Encodes 16S rRNA from Aquiflexum
agagtttgatcatggctcaggatgaacgctggcggcaggcttaatacatgcaagtcgaacggtaaggcctgaagtggcaacacggagggtacacgagtggcgcacgggtgcgtaacgcgtatgcaacctgcccccaaccgggacaaaacagctggaaacggctgctaatatcccatagtcatgaggaggggcatccctctttatgtaaagattcattggttgggg

SEQ ID NO: 455 - DNA, 225 bp, Unknown
  Encodes 16S rRNA from Pedobacter
agagtttgatcatggctcaggatgaacgctagcggcaggcctaatacatgcaagtcgaacgggaaggggcccttcggggcctctgagagtggcgcacgggtgcgtaacgcgtatgcaaccaaccccgcactgggggacagccggtggaaacgccgggtaataccccatgccgacgggaggggacatccccatccgttgaaaggcttcggtcggtgcgggacgggc

SEQ ID NO: 456 - DNA, 225 bp, Unknown
  Encodes 16S rRNA from Robinsoniella
agagtttgatcctggctcaggatgaacgctggcggcgtgcctaacacatgcaagtcgaacggagtaacaattcttcggaaatgttacttagtggcggacgggtgagtaacgcgtgggtaacctgcctcatacagggggatagcagctggaaacggctgataataccgcataagcgcacagagacgcatgtttcagtgtgaaaaactccggtggtatgagatggac

SEQ ID NO: 457 - DNA, 225 bp, Unknown
  Encodes 16S rRNA from Pelomonas
agagtttgatcatggctcagattgaacgctggcggcatgccttacacatgcaagtcgaacggtaacaggttaagctgacgagtggcgaacgggtgagtaatatatcggaacgtgcccagtcgtgggggataactgctcgaaagagcagctaataccgcatacgacctgagggtgaaagcgggggatcgcaagacctcgcgcgattggagcggccgatatcagatt

SEQ ID NO: 458 - DNA, 225 bp, Unknown
  Encodes 16S rRNA from Saccharofermentans
agagtttgatcatggctcaggatgaacgctggcggcgtgcttaacacatgcaagtcgaacggagtttagtggaatgcgacttcggtcaaatgaaattaaacttagtggcggacgggtgagtaacgtgtgagcaacctgcctttcagagggggataacgcagagaaatttgcgctaataccgcatgacatgtcggaatcgcatggatctgacatcaaaggagcaat

SEQ ID NO: 459 - DNA, 225 bp, Unknown
  Encodes 16S rRNA from Paracoccus
agagtttgatcctggctcagaacgaacgctggcggcaggcctaacacatgcaagtcgagcgaggacttcggtcctagcggcggacgggtgagtaacgcgtgggaacgtgccccttgctgcggaatagccccgggaaactgggattaataccgcatgatccccctgatcatggagatctgggggcaaagatttatcggcaagggatcggcccgcgttggattaggt

SEQ ID NO: 460 - DNA, 225 bp, Unknown
  Encodes 16S rRNA from Enterorhabdus
agagtttgatcatggctcaggatgaacgctggcggcgtgcctaacacatgcaagtcgaacggttaaaccggcttcggccggacatagagtggcgaacgggtgagtaacacgtgaccaacctgccccgcgcaccgggatagccccccgaaagggggattaataccggatgcgccggccgggccgcatggcccggccgggaaagcccaggcggcgcgggatggggtc

SEQ ID NO: 461 - DNA, 225 bp, Unknown
  Encodes 16S rRNA from Beijerinckia
agagtttgatcatggctcagagcgaacgctagcggaatgctttatacatgcaagtcgaacggaaaattaaatgaagtagcaatatggatttgaagtttttagtggcgaacgggtgagtaatatataggaatttgcccagtagtggggaacaacagatagaaatgtctgctaataccgcatacgtccgagaggagaaagtcacaagacgctattggagaagcctat

SEQ ID NO: 462 - DNA, 225 bp, Unknown
  Encodes 16S rRNA from Sporobacter
agagtttgatcctggctcaggacgaacgctggcggcgtgcctaacacatgcaagtcgaacgggatcctcatgaaggagttttcggacaacggaatggggcatctagtggcggacgggtgagtaacgcgtgagcaacctgcccttcggagggggacaacagttggaaacgactgctaataccgcataacatataccggtggcatcatgggtatatcaaagatttat

SEQ ID NO: 463 - DNA, 225 bp, Unknown
  Encodes 16S rRNA from Clostridium IV
agagtttgatcatggctcaggatgaacgctggcggcgtgcataacacattcaagtcgaacggacttagaggggcttgctcctcgaaagttagtggcggacgggtgagtaacgcgtgagcaacctgcctttctccgggggataacattgggaaaccggtgctaataccgcataacgtacagagatcgcatgttttttgtaccaaagattcattggggaaagatggg

SEQ ID NO: 464 - DNA, 225 bp, Unknown
  Encodes 16S rRNA from Bacillus
agagtttgatcctggctcaggatgaacgctggcggcgtgcctaatacatgcaagtcgaacggagtatcttcggatacttagtggcgaacgggtgagtaatacttgaacaacctgcccctttgactgggataaccgtctgaaaagacagctaataccggataggtaatattgaggcatctcgatattattaaagatgggttacatcacattgggatgggttcaagt

SEQ ID NO: 465 - DNA, 225 bp, Unknown
  Encodes 16S rRNA from Saccharofermentans
agagtttgatcctggctcaggacgaacgctggcggcgtgcttaacacatgcaagtcgagcgaggggatacggcttcggctgtagactcgagcggcggacgggtgagtaacgcgtgaacgatctgtcccatacagggggataccacttggaaacaggtgctaataccgcataagaccacgaagctgcatggctttgaggtaaaaggagcgatccggtatggggtga

SEQ ID NO: 466 - DNA, 225 bp, Unknown
  Encodes 16S rRNA from Spirochaeta
agagtttgatcatggctcagaacgaacgctggcggcgcgtcttaagcatgcaagtcgagcgggattgggtagcttgctactcatgagagcggcggactggtgagtaacgcgtgggtgacgtaccctttagacggggatagctcctagaaataggaggtaataccggatacgatagtgagtgtcagaggctcattatgaaaggttcttttgaaccgctgaaggagc

SEQ ID NO: 467 - DNA, 225 bp, Unknown
  Encodes 16S rRNA from Prevotella
agagtttgatcatggctcaggatgaacgctagctacaggcttaacacatgcaagtcgaggggaaacgatgagagagcttgctctctcaggcgtcgaccggcgcacgggtgagtaacacgtatccaacctgcctttttccagggaataaccttgcgaaagtaagactaatgccctatgtgtcctttgacggcatcagacgaggacgaaagatttatcggaaaggga

SEQ ID NO: 468 - DNA, 225 bp, Unknown
  Encodes 16S rRNA from Eubacterium
agagtttgatcatggctcaggattaacgctggcggcgtgcctaacacatgcaagtcgagcgagaaatggtgaaatgaaacttcggtagattagatccatggacagcggcggacgggtgagtaacgcgtgggcaacctgcccctttccggaggatagccaagggaaactttgaataatactccataaagcaagagtaccgcatgatacacttgccaaagatttatc

SEQ ID NO: 469 - DNA, 225 bp, Unknown
  Encodes 16S rRNA from Herbiconiux
agagtttgatcctggctcaggacgaacgctggcggcatgcctaacacatgcaagtcgaacggacgagggtagcaatacccaagttagtggcgaacgggtgagtaacacgtgagcaacctgccctttacactgggatagcagttggaaacgactgataataccggataagaccacgctcccgcatgggagaggggtcaaagtgaattagcggtaaaggatgggctc

SEQ ID NO: 470 - DNA, 225 bp, Unknown
  Encodes 16S rRNA from Brevundimonas
agagtttgatcctggctcagagcgaacgctggcggcaggcctaacacatgcaagtcgaacggacccttcggggttagtggcggacgggtgagtaacacgtgggaacgtgcctttaggttcggaatagctcctggaaacgggtggtaatgccgaatgtgcccttcgggggaaagatttatcgcctttagagcggcccgcgtctgattagctagttggtgaggtaat

SEQ ID NO: 471 - DNA, 225 bp, Unknown
  Encodes 16S rRNA from Mogibacterium
agagtttgatcatggctcaggatgaacgctggcggcgtgcctaatacatgcaagtcgagcgagaatctctgacatgacgcttcggttgattggaagagaggacagcggcggacgggtgagtaacgcgtaggcaacctgcccccgacagagggatagccattggaaacgatgattaaaacctcataacgctcgtatgacacatgtcatatgagccaaagatttatc

SEQ ID NO: 472 - DNA, 225 bp, Unknown
  Encodes 16S rRNA from Anaerorhabdus
agagtttgatcatggctcaggattaacgctggcggcgtgcctaatacatgcaagtcgtacgggtgattctagcttgctagatgatccagtggcgaacgggtgagtaatacataaacaacctacctataaggactgggataacgcttggaaacgagtgctaataccggataggtaacgggagggcatcctcctgttattaaaggattactacacaaatagatgggt

SEQ ID NO: 473 - DNA, 225 bp, Unknown
  Encodes 16S rRNA from Victivallis
agagtttgatcctggctcagaacgaacgctggcggcatggattaggcatgcaagtcgaacgaagcagcaatgcttagtggcggaagggtgaggaacgcgtgagtaatctgcccccaagttgggaataacagctggaaacggctgctaataccgaatgtggctgtcgggtcgcatgatctgacagttaaagatttattgcttggggatgagctcgcgtcccattag

SEQ ID NO: 474 - DNA, 225 bp, Unknown
  Encodes 16S rRNA from Prevotella
agagtttgatcatggctcaggatgaacgctagctacaggcctaacacatgcaagtcgaggggcagcatgggagaagcttgcttttcccgatggcgaccggcgaatgggtgagtcacgcgtgtccaacctgcctccggcccggggatagcccttggaaatgaggattaagacccgataggtggagcttccgcatggcggctccatgaaacgagaccggagatgggg

SEQ ID NO: 475 - DNA, 225 bp, Unknown
  Encodes 16S rRNA from Anaerovorax
agagtttgatcctggctcaggatgaacgctggcggcgtgcctaacacatgcaagtcgagcgggaaatacggaaatgaaggttcgctggaatttctgtatggagagcggcggacgggtgagtaacgcgtaggcaacctgccctttgcagagggatagccactggaaacggtgattaaaacctcataatgccatttgttcacatgttcagatggccaaagatttatc

SEQ ID NO: 476 - DNA, 225 bp, Unknown
  Encodes 16S rRNA from Aquiflexum
agagtttgatcatggctcaggatgaacgctggcggcaggcttaatacatgcaagtcgaacggtaaggcctgaagtggcaacacggagggtacacgagtggcgcacgggtgcgtaacgcgtatgcaacctgcccctaaccgggacaaaacagctggaaacggctgctaatatcccatggccacacgagggggcatccccatgtgtgtaaagattcattggttaggg

SEQ ID NO: 477 - DNA, 225 bp, Unknown
  Encodes 16S rRNA from Oscillibacter
agagtttgatcctggctcaggacgaacgctggcggcgtgcctaacacatgcaagtcgaacggagtgatttggattcgtctggatcacttagtggcggacgggtgagtaacgcgtgagcaacctgcccttcagagggggacaacagttggaaacgactgctaataccgcataatatatacttaaggcatcttaggtatatcaaagattttatcgctgaaggatggg

SEQ ID NO: 478 - DNA, 225 bp, Unknown
  Encodes 16S rRNA from Altererythrobacter
agagtttgatcctggctcagaacgaacgctggcggcacgcttaacacatgcaagtcgaacgagattgcgggttcgctcgtaatttagtggcgcacgggtgaggaacgcgtgactacctgcctgttgatggtggataactccgggaaactggagctaatacagcataagctcgagagaggaaagacaaaagtcgtcgacagagggggttgcgtctgattaggtagt

SEQ ID NO: 479 - DNA, 225 bp, Unknown
  Encodes 16S rRNA from Hydrogenoanaerobacterium
agagtttgatcctggctcaggacgaacgctggcggcacgcttaacacatgcaagtcgaacgaagcttgggagcttgctttcaagcttagtggcggacgggtgagtaacacgtgagcaacctgccttcaggtgtggaataatggttggaaacggccactaataccgcataatgcagcgggatcgcatgatcctgctgccaaaggtttactgcctgaagatgggctc

SEQ ID NO: 480 - DNA, 225 bp, Unknown
  Encodes 16S rRNA from Clostridium III
agagtttgatcatggctcaggacgaacgctggcggcgtgcctaacacatgcaagtcgaacgagaagtcttgaaatgatcccttcggggtgaatggatagatggacagtggcggacgggcgagtaacgcgtgagtaacctgcccataagagagggatagccgatggaaacgtcgagtaatacctcatattgtaattaattcgcatggattgattatgaaagattta

SEQ ID NO: 481 - DNA, 225 bp, Unknown
  Encodes 16S rRNA from Clostridium XlVb
agagtttgatcctggctcaggatgaacgctggcggcgtgcctaacacatgcaagtcgagcgaagcataggtgcttgcacttatgacttagcggcggacgggtgagtaacgcgtgggtaacctgccctgtacaggggaataacagttagaaatgactgctaatgccccataagccgacgtaatggcatctttatgtcggaaaagatttatcggtacaggagggacc

SEQ ID NO: 482 - DNA, 225 bp, Unknown
  Encodes 16S rRNA from Saccharofermentans
agagtttgatcatggctcaggacgaacgctggcggcgtgcctaacacatgcaagtcgagcggggacagcggattagcttgctaagctgctgttccagcggcggacgggtgagtaacgcgtgaacaatctgtcccagacagggggataacacttggaaacaggtgctaataccgcataagaccacagtgccgcatggcagaggggtaaaaggagcaatccggtctg

SEQ ID NO: 483 - DNA, 225 bp, Unknown
  Encodes 16S rRNA from Roseburia
agagtttgatcatggctcaggatgaacgctggcggcgtgcttaacacatgcaagtcgaacgaatttctttcggaacgcggcttcggccaagggaagagagaagtgagtggcggacgggtgagtaacgcgtgggtaacctgcctcacatcgggggataccagtcggaaacgactgctaaaaccgcataagaccacggtatcgcatgatactgaggccaaaactccg

SEQ ID NO: 484 - DNA, 225 bp, Unknown
  Encodes 16S rRNA from Anaeroplasma
agagtttgatcatggctcaggattaacgctggcggcatgcctaatacatgcaagtcgaatgagaagcttgcttctcatggcgaacgggtgagtaacacgtaggtaacctgccttacactcgaggataaccgttggaaacgacggataatactggataggacaaagattcgcatgaatcgttgtttaaaagcaatggtgtatgaggggcctgcggtgcattagcta

SEQ ID NO: 485 - DNA, 225 bp, Unknown
  Encodes 16S rRNA from Planctomyces
agagtttgatcctggctcagaatgaacgttggcggcatggattaggcatgcaagtcgtacggtgaaggggagcttgctcctctgatcagtggcgaaagggatagtaacgcgtagataccaccctcctggacggggatagctgcgggaaactgcaggtaatacccgataatgacgagagtccaaaggtgtaattccttcaggagacggatctgcgtcctaccagat

SEQ ID NO: 486 - DNA, 225 bp, Unknown
  Encodes 16S rRNA from Ruminococcus
agagtttgatcctggctcaggacgaacgctggcggcacgcttaacacatgcaagtcgaacggagataatggatttattcgttatcttagtggcggacgggtgagtaacacgtgagcaacctgcctttaagagggggatagcttctggaaacggatggtaataccctataaaatatatttaaggcatcttaggtatatcaaagatttatcacttaaagatgggctc

SEQ ID NO: 487 - DNA, 225 bp, Unknown
  Encodes 16S rRNA from Selenomonas
agagtttgatcctggctcaggacgaacgctggcggcgtgcttaacacatgcaagtcgaacgagaaaatattggaagcttgcttttgatagattcgagtggcaaacgggtgagtaacgcgtagacaacctgccgcaaagatggggacaacagatcgaaaggtctgctaataccgaatgttgcggagctcccgcatgggagctccgccaaagatggcctctacttgt

SEQ ID NO: 488 - DNA, 225 bp, Unknown
  Encodes 16S rRNA from Anaeroplasma
agagtttgatcatggctcaggattaacgctggcggcgtgcctaatacatgcaagtcgaatggtagtagcaatacaaaccatggcgaacgggtgagtaacacgtaggtaacctgtctttaagacgaggataaccgttggaaacgacggataatactggataggacattacaaggggcatcccaaaatgtttaaagattattatgtcacttagagaggggcctgcgg

SEQ ID NO: 489 - DNA, 225 bp, Unknown
  Encodes 16S rRNA from Anaerovorax
agagtttgatcatggctcaggatgaacgctggcggcgtgcctaacacatgcaagtcgagcgggaaatctcggaaataagcttcggcagaaataagagatggatagcggcggacgggtgagtaacgcgtaggtaacctgccctttgcagagggatagcctagggaaacctggattaataccacataatgcagtctggtcacatggcgaggctgccaaagatttatc

SEQ ID NO: 490 - DNA, 225 bp, Unknown
  Encodes 16S rRNA from Rummeliibacillus
agagtttgatcctggctcaggacgaacgctggcggcgtgcctaatacatgcaagtcgagcgaatgacgagaagcttgcttctctgatttagcggcggacgggtgagtaacacgtgggcaacctgccctgtagactgggataacttcgggaaaccggagctaataccggataattcttttagcctcatggctttaagctaaaaggcgcttcggcgtcactacagga

SEQ ID NO: 491 - DNA, 225 bp, Unknown
  Encodes 16S rRNA from Clostridium XlVa
agagtttgatcctggctcaggatgaacgctggcggcgtgcctaacacatgcaagtcgaacgaggtgcagtaaacggagattcgtcgaagggaactgtatccgagtggcggatgggtgagtaacgcgtggagaacctgcccttatcagggggataacaactggaaacggttgacaataccgcataagcttcggttatcgcatgatagcagaaggaaagatttatcg

SEQ ID NO: 492 - DNA, 225 bp, Unknown
  Encodes 16S rRNA from Anaeroplasma
agagtttgatcctggctcaggattaacgctggcggcgtgcctaatacatgcaagtcgaatggttagcttgctaaccatggcgaacgggtgagtaacacgtaggtaacctgtcttttagccgaggataaccattggaaacgatggataatactggataggacatttgaaggcatctttggatgtttaaagatttatcactagaagaggggcctgcggcgcattagc

SEQ ID NO: 493 - DNA, 225 bp, Unknown
  Encodes 16S rRNA from Butyrivibrio
agagtttgatcctggctcaggatgaacgctggcggcgtgcctaacacatgcaagtcgaacggagtttgtagaacggaagtcttcggatggaagatttataaacttagtggcggacgggtgagtaacgcgtgggtaacctgcctcgtacagggggatagcagctggaaacggctggtaaaaccgcataagcgcacaacttcgcatgaaggagtgtgaaaatattta

SEQ ID NO: 494 - DNA, 225 bp, Unknown
  Encodes 16S rRNA from Lachnospiracea incertae sedis
agagtttgatcctggctcaggatgaacgctggcggcgtgcctaacacatgcaagtcgaacgggaaccttgtgacggagacttcggttgaagaagcaagaattctagtggcggacgggtgagtaacgcgtgggtaacctgcccttaagaggcgaataacagtgagaaatcactgctaatacgccatatgcttacggaatcgcatgattttgtgaggaaaagaattt

SEQ ID NO: 495 - DNA, 225 bp, Unknown
  Encodes 16S rRNA from Anaerotruncus
agagtttgatcatggctcaggacgaacgctggcggcgtgcctaacacatgcaagtcgaacgaagttattacgctgaaatgatattagcttgctaaaggaatttcttgtaatgcttagtggcggacgggtgagtaacgcgtgagcaacctgcctttcagagggggacaacagttggaaacgactgctaataccgcataacattgtttaaagacatctttagataat

SEQ ID NO: 496 - DNA, 225 bp, Unknown
  Encodes 16S rRNA from Syntrophococcus
agagtttgatcctggctcaggatgaacgctggcggcgtgcctaacacatgcaagtcgaacgaggctcttctctctgacgtttcgactgattagagaagatcaccgagtggcggatgggtgagtaacgcgtggagaacctgcccccatcagggggataacaactggaaacggttgataataccgcatatatgacaagaccgcatgatcttgtcaggaaagatttat

SEQ ID NO: 497 - DNA, 225 bp, Unknown
  Encodes 16S rRNA from Paraeggerthella
agagtttgatcctggctcaggatgaacgctggcggcgtgcctaacacatgcaagtcgaacggttaaaccggcttcggccggacataaagtggcgaacgggtgagtaacacgtgaccaacctgccccgcgcaccgggacagccccccgaaagggggattgataccggatgctccgccccctccgcatggcgggggcgggaaagcccaggcggcgcgggatggggtc

SEQ ID NO: 498 - DNA, 225 bp, Unknown
  Encodes 16S rRNA from Papillibacter
agagtttgatcatggctcaggataaacgctggcggcgtgcttaacacattcaagtcgaacggacgacagggggcttgctccctgaagttagtggcggacgggtgagtaacgcgtgagcaacctgccttttttcgggggataacacggggaaaccggtgctaataccgcataacgtaccgagatcgcatggtcatggtaccaaaggagcaatccgaggaaagatgg

SEQ ID NO: 499 - DNA, 225 bp, Unknown
  Encodes 16S rRNA from Lachnospiracea incertae sedis
agagtttgatcctggctcaggatgaacgctggcggcgtgcctaacacatgcaagtcgagcggacttatgacaagattcttcggatgatttttataagttagcggcggatgggtgaggaacgcgtggagaacctgcccttcacagggggataacagttggaaacgactgttaataccgcatatgctcacgtgaccgcatggtcgagtgaggaaagctccggcggtg

SEQ ID NO: 500 - DNA, 225 bp, Unknown
  Encodes 16S rRNA from Prevotella
agagtttgatcctggctcaggatgaacgctagctacaggcttaacacatgcaagtcgaggggcatcaggtactgtgcttgcacagtatgctggcgaccggcgcacgggtgagtaacgcgtatccaaccttcccatgactccggttcagcccgccgaaaggcggattactcccggatggtttccgaagagggcctctgatttggaataaagatttatcggtcatgg

SEQ ID NO: 501 - DNA, 225 bp, Unknown
  Encodes 16S rRNA from Papillibacter
agagtttgatcctggctcaggacgaacgctggcggcgtgcctaacacatgcaagtcgaacggagcgagaggagcttgctcttctcgcttagtggcggacgggtgagtaacgcgtgagcaacctggctttcagaggggaataacacagtgaaaactgtactaataccgcataacgtctcttgggcgcatgcccgagggaccaaaggagcaatccgctgaaagatgg

SEQ ID NO: 502 - DNA, 225 bp, Unknown
  Encodes 16S rRNA from Streptococcus
agagtttgatcctggctcaggatgaacgctggcggcgtgcttaatacatgcaagtcgaacggatgattcttccagcttgctggaagatgattcagtggcgaacgggtgagtaatacgtaggcaacctgccccaaagcgggggatagcagttggaaacgactattaataccgcataggtaatcttaaggcatcttgagattattaaaggtgcgtttgcaccgctgt

SEQ ID NO: 503 - DNA, 225 bp, Unknown
  Encodes 16S rRNA from Methanobrevibacter
agagtttgatcatggcagatgttactgctattgggattcgattaagccatgcaagtcgaacgaatttagattcgtggcgtacggctcagtaacacgtggataacctacccttaggaccgggataaccttgggaaactgaggataatactggataggcaattattcctgtaatggttttttgtttaaatgttttttcgcctaaggatgggtctgcggccgattagg

SEQ ID NO: 504 - DNA, 225 bp, Unknown
  Encodes 16S rRNA from Prevotella
agagtttgatcatggctcaggatgaacgctagctacaggcttaacacatgcaagtcgaggggcatcatggcggtggcttgccaccgctgatggcgaccggcgcacgggtgagtaacgcgtatccaacctgcccccaaccgcggcacagcccgccgaaaggcggattaattccgcatgtggtcgtgatgtgacatcttttcacgactaaaggttcactccggttgg

SEQ ID NO: 505 - DNA, 225 bp, Unknown
  Encodes 16S rRNA from Prevotella
agagtttgatcatggctcaggatgaacgctagctacaggcttaacacatgcaagtcgaggggcagcgagggggcagcaatgcccctgtcggcgaccggcgcacgggtgagtaacgcgtatccaacctgccccatggtagggaatagcccggagaaatccggattaatgccctatgttctccgacgatggcatctgacttggagcaaagatttatcgccatgggat

SEQ ID NO: 506 - DNA, 225 bp, Unknown; identical to SEQ ID NO: 474
  Encodes 16S rRNA from Prevotella

SEQ ID NO: 507 - DNA, 225 bp, Unknown
  Encodes 16S rRNA from Coraliomargarita
agagtttgatcatggctcagagtgaacgctggcggcgtggctaagacatgcaagttgagcgagaatatgcctttgggcatagggaagcggcaaacgggtgagtaacacgtaagtaacctacccttaagactgggatagccctgtgaaagtgggggtaataccggatgaggactatgactgcatggttatagatcgaaaggtttgtaaaggcgcttaaggaggggc

SEQ ID NO: 508 - DNA, 225 bp, Unknown
  Encodes 16S rRNA from Prevotella
agagtttgatcctggctcaggatgaacgctagctacaggcttaacacatgcaagtcgcggggcagcatgttgtgtgcttgcacacaatgatggcgaccggcgcacgggtgcgtaacgcgtatccaacctgccccttactctggaatagcccggcgaaagtcggattaatgccggatgttgtcagatgaggacatctgagtttgaccaaaggccctttgggtcggt

SEQ ID NO: 509 - DNA, 225 bp, Unknown
  Encodes 16S rRNA from Thermotalea
agagtttgatcctggctcaggattaacgctggcggcgtgcctaacacatgcaagtcgagcgagaaatagtgaagagatacttcggttgaacggatctatggacagcggcggacgggtgagtaacgcgtgggcaacctacccctttcccgaggatagccaagggaaactttgaataatactccataaagcagatgtaccgcatgatacgactgccaaagatttatc

SEQ ID NO: 510 - DNA, 225 bp, Unknown
  Encodes 16S rRNA from Clostridium XlVa
agagtttgatcatggctcaggatgaacgctggcggcgtgcttaacacatgcaagtcgaacgaagcaggtttgaaggagacttcggtcaatggatgatctgacttagtggcggacgggtgagtaacgcgtgggcaacctgcctcatggagggggacaacagttggaaacgactgctaataccgcataagaccaagcatcgcatgatgcaatggtaaaagatttatc

SEQ ID NO: 511 - DNA, 225 bp, Unknown
  Encodes 16S rRNA from Atopobium
agagtttgatcatggctcaggatgaacgctggcggcgcgcctaacacatgcaagtcgaacggttaaagccccttcgggggtgtataaagtggcgaacggctgagtaacacgtgggcaacctacctctcactccgggatagcctcgagaaatcgtggataataccggatactccaggataatcgcatggttttcctgggaaagccccgacggtgagagatgggccc

SEQ ID NO: 512 - DNA, 225 bp, Unknown
  Encodes 16S rRNA from Prevotella
agagtttgatcatggctcaggatgaacgctagctacaggcttaacacatgcaagtcgaggggtaacatgacgaaagcttgcttttgttgatgacgaccggcgcacgggtgagtaacgcgtatccaacctgccctgtactacgggatagcccggcgaaagtcggattaataccgtatgtggtgtgataaagacatctgcattacactaaagatttatcggtacagg

SEQ ID NO: 513 - DNA, 225 bp, Unknown
  Encodes 16S rRNA from Mogibacterium
agagtttgatcatggctcaggatgaacgctggcggcgtgcctaatacatgcaagtcgagcgagaagctactttgaagcgttttcgaacaattctgtgtagtggaaagcggcggacgggtgagtaacgcgtaggcaacctgcccttagcagagggatagccattggaaacgatgattaaaacctcataatgccaacttaacacatgttgagctggccaaagattta

SEQ ID NO: 514 - DNA, 225 bp, Unknown
  Encodes 16S rRNA from Clostridium XlVa
agagtttgatcatggctcaggatgaacgctggcggcgtgcttaacacatgcaagtcgaacgaggaattgcgaaagaagttttcggatggattttgcttttccgagtggcggacgggtgagtaacgcgtgggtaacctgccttacactgggggacaacagagagaaatttctgctaataccgcataacccgctatgagcgcatgctcaagacggaaaagatttatc

SEQ ID NO: 515 - DNA, 225 bp, Unknown
  Encodes 16S rRNA from Clostridium XlVa
agagtttgatcctggctcaggatgaacgctggcggcgtgcctaacacatgcaagtcgaacgaagaccccgaggcagagatttcggtcgaagccaagggaggactgagtggcggacgggtgagtaacgcgtggataacctgccccatacagggggatagcagttggaaacgactgataataccgcataagcgcacggggagacatctctttgtgtgaaaagattta

SEQ ID NO: 516 - DNA, 225 bp, Unknown
  Encodes 16S rRNA from Eggerthella
agagtttgatcctggctcaggatgaacgctggcggcgtgcctaacacatgcaagtcgaacggtgaaaccgccctcgggcggacatgaagtggcgaacgggtgagtaacacgtgaccaacctgccccgcgcaccgggacagccccccgaaagggggattaataccggatactccggccgggccgcatggcccggccgggaaagctccggcggcgcgggatggggtc

SEQ ID NO: 517 - DNA, 225 bp, Unknown
  Encodes 16S rRNA from Blautia
agagtttgatcatggctcaggatgaacgctggcggcgtgcctaacacatgcaagtcgaacggagatcatttggaaataagcttcggcagaaagaaggatgatcttagtggcggacgggtgagtaacgcgtggagaacctgccctgtacagggggataacatccagaaatggatgctaaaaccgcataagcgcacatgaccgcatggtcaagtgtgaaaaactccg

SEQ ID NO: 518 - DNA, 225 bp, Unknown
  Encodes 16S rRNA from Vampirovibrio
agagtttgatcatggctcaggacgaacgctggcggtgtgcctcatacatgcaagtcgaacgataaggttccttcgggaatacataagtggcggacgggtgagtacaacataggaaatctgccctaaactgggggacaacagagggaaactcctgctaataccccatacgagcttagttgaaatactaatcttgaaagctccggcggtttaggatgagcctgtgcc

SEQ ID NO: 519 - DNA, 225 bp, Unknown
  Encodes 16S rRNA from Papillibacter
agagtttgatcatggctcaggataaacgctggcggcgtgcttaacacattcaagtcgaacggacgacagggggcttgctccctgaagttagtggcggacgggtgagtaacgcgtgagcaacctgcctttttccgggggataacacggggaaaccggtgctaataccgcataacgtgccgagatcgcatggtcatggtaccaaaggagcaatccggggaaagatgg

SEQ ID NO: 520 - DNA, 225 bp, Unknown
  Encodes 16S rRNA from Beijerinckia
agagtttgatcatggctcagaacgaacgctggcggcaggcttaacacatgcaagtcgaacgccccgcaaggggagtggcagacgggtgagtaacgcgtgggaacataccctttcctgcggaatagctccgggaaactggaattaataccgcatacgccctacgggggaaagatttatcggggaaggattggcccgcgttggattagctagttggtggggtaaagg

SEQ ID NO: 521 - DNA, 225 bp, Unknown
  Encodes 16S rRNA from Bacteroides
agagtttgatcatggctcaggatgaacgctagctacaggcttaacacatgcaagtcgaggggcagcattagattagcttgctaatctagatggcgaccggcgcacgggtgagtaacgcgtatccaacctgccccctacccggggatagccttgcgaaagtaagattaatacccggtgctgttatgattccgcatggggatataacgaaagattcatcggtagggg

SEQ ID NO: 522 - DNA, 225 bp, Unknown
  Encodes 16S rRNA from Desulfotomaculum
agagtttgatcatggctcaggacgaacgctggcggcgtgcttaacacatgcaagtcgaacggagcttaaggaagagcttgctctgagataagcttagtggcggacgggtgagtaacgcgtgaggaacctggtttacacagggggataacggcccgaaagggttgctaataccgcataagaccacaacaccgcatgatgaaggggtcaaaggagaaatccggtgta

SEQ ID NO: 523 - DNA, 225 bp, Unknown
  Encodes 16S rRNA from unknown taxa
agagtttgatcatggctcaggataaacgctggcggcgtgcattatgcatgcaagtcgaacgagatacgcaagtatcgagtggcaaacgggtgagtaacacatagataacctaccctcgagtggggaataattctccgaaaggaggactaataccgcatacgatggcttttcacaagaagagttattaaagcagcaatgcgcttgaggaggggtctgtgtccgatt

SEQ ID NO: 524 - DNA, 225 bp, Unknown
  Encodes 16S rRNA from Clostridium XlVa
agagtttgatcatggctcaggatgaacgctggcggcgtgcttaacacatgcaagtcgaacgaatttctgttagaatgcggcttcggccaagtgaagacagaagtgagtggcggacgggtgagtaacgcgtgggtaacctaccttacacagggggataacgattggaaacgatcgctaataccgcataagaccacagtgccgcatggtacaggggtaaaagattta

SEQ ID NO: 525 - DNA, 225 bp, Unknown
  Encodes 16S rRNA from Clostridium XlVa
agagtttgatcatggctcaggatgaacgctggcggcgtgcctaacacatgcaagtcgaacgggcactggcggaagaagccttcgggtggaagctgccagagctagtggcggacgggtgagtaacgcgtggataacctgccctgttccgggggataacagctggaaacggctgctaataccgcataagcgcacgaggcggcatcgcctagtgtgaaaaactccggt

SEQ ID NO: 526 - DNA, 225 bp, Unknown
  Encodes 16S rRNA from Clostridium XlVa
agagtttgatcatggctcaggatgaacgctggcggcgtgcctaacacatgcaagtcgaacggaaatgatttgatgaaggtttcggttggattcttatcattttagtggcggacgggtgagtaacacgtgggtaacctgccctgtaccgggggataacacttagaaataggtgataataccgcataagcgcacactgacgcatgtcagagtgtgaaaaactccggt

SEQ ID NO: 527 - DNA, 225 bp, Unknown
  Encodes 16S rRNA from Cryptanaerobacter
agagtttgatcatggctcaggacgaacgctggcggcatgcctaacacatgcaagtcgaacggaataagtttggttgtagcgatactttcgaacttatttagtggcgaacgggtgagtaacacgtgagcaacctgccttttacacagggataacagccggaaacggctgctaataccggataagaccacaccgaggcatctcggaggggtcaaagcgcttagcggt

SEQ ID NO: 528 - DNA, 225 bp, Unknown
  Encodes 16S rRNA from Prevotella
agagtttgatcatggctcaggatgaacgctagctacaggcctaacacatgcaagtcgaggggcagcatgtcggtagcttgctaccgatgatggcgaccggcggatgggtgagcaacgcgtatccaacctgccccatgcgcggggatagcccttggaaatgaggattaagccccgatatgcgcattcgccgcatggcgtgtgcgtgaagttgtgcatgggatgggg

SEQ ID NO: 529 - DNA, 225 bp, Unknown
  Encodes 16S rRNA from Syntrophomonas
agagtttgatcatggctcaggacgaacgctggcggcgtgcctaacacatgcaagtcgaacggaaactattcgagaatttcggttcatgaatagttttagtggcggacgggtgagtaacgcgtgagaatctgcctttgagtggggaataacagttggaaacgactgctaataccgcataacatggaaacatcaaagagggtgcaagccctcgctcagagatgagct

SEQ ID NO: 530 - DNA, 225 bp, Unknown
  Encodes 16S rRNA from Erysipelothrix
agagtttgatcatggctcaggatgaacgctggcggcgtgcttaatacatgcaagtcgaacgcacgagattacttcggtgatcgagtgagtggcgaacgggtgagtaatacataaggaacctgcccatcagactgggataacagttggaaacgactgctaataccggataggtagttgagtggcatcacatagctattaaagttgagatacactgatggatggcct

SEQ ID NO: 531 - DNA, 225 bp, Unknown
  Encodes 16S rRNA from Selenomonas
agagtttgatcctggctcaggacgaacgctggcggcgtgcttaacacatgcaagtcgaacgagacgattgaaagcttgcttttgaaagtcgagtggcaaacgggtgagtaacgcgtaggcaacctgcctctaggatggggacaacagtccgaaaggactgctaataccgaatgttgtaggtattccgcatggaatacctattaaagatggcctctacttgtaagc

SEQ ID NO: 532 - DNA, 225 bp, Unknown
  Encodes 16S rRNA from Clostridium III
agagtttgatcatggctcaggacgaacgctggcggcgtgcctaacacatgcaagtcgagcgagaatctttcatttgatcccttcggggtgacgacggaagaggaaagcggcggacgggtgagtaacgcgtgagtaatctgccccatggtggggaataacacagtgaaaactgtgctaatgccccataatgtatacttgttgcatagcagggataccaaagattta

SEQ ID NO: 533 - DNA, 225 bp, Unknown
  Encodes 16S rRNA from Flavobacterium
agagtttgatcctggctcaggatgaacgctagcggcaggcctaacacatgcaagtcgaggggtagagatagcttgctatcttgagaccggcgcacgggtgcgtaacgcgtatgcaatctaccttatactaagggatagcccggagaaatccggattaataccttatggtttttatgaatagcattatttatagaataaagatttatcggtataagatgagcatgc

SEQ ID NO: 534 - DNA, 225 bp, Unknown
  Encodes 16S rRNA from Thermotalea
agagtttgatcctggctcaggatgaacgctggcggcgtgcttaacacatgcaagtcgagcgagaaatgacagacggattcttcggatgacagaagtcatggacagcggcggacgggtgagtaacgcgtgggcaacctgcccctgactgagggatagccgagggaaacttcgagtaatacctcataacgcataactgtcgcatggcagatatgccaaagatttatc

SEQ ID NO: 535 - DNA, 225 bp, Unknown
  Encodes 16S rRNA from Lachnospiracea incertae sedis
agagtttgatcatggctcaggatgaacgctggcggcgcgcttaacacatgcaagtcgaacggaatttgtaacttcggttgtggattcagtggcggacgggtgagtaacacgtggataacttgccttttagtgggggatagctgagagaaatctcaattaataccgcataatgtaatttgttcgcatgaatagattaataaagatgaaaatcgctaagagataggt

SEQ ID NO: 536 - DNA, 225 bp, Unknown
  Encodes 16S rRNA from Mucilaginibacter
agagtttgatcatggctcaggatgaacgctagcggcaggcctaatacatgcaagtcggacgggaactccccttcgggggagtgagagtggcgcacgggtgcgtaacgcgtatgcaaccaaccctcatccgggggacagccggtggaaacgccgggtaataccccatgtccactttgggaggcatcttctgaggtggaaagactttggtcggaggaggacgggcat

SEQ ID NO: 537 - DNA, 225 bp, Unknown
  Encodes 16S rRNA from Bacteroides
agagtttgatcctggctcaggatgaacgctagctacaggcttaacacatgcaagtcgaggggcagcattagattagcttgctaatctagatggcgaccggcgcacgggtgagtaacgcgtatccaacctgccccctacccggggatagccttgcgaaagtaagattaatacccggtgctgttgcgattccgcatggggatgcaacgaaagattcatcggtagggg

SEQ ID NO: 538 - DNA, 225 bp, Unknown
  Encodes 16S rRNA from Ruminococcus
agagtttgatcctggctcaggacgaacgctggcggcacgcttaacacatgcaagtcgaacggagttaaataagcttgcttatttaacttagtggcggacgggtgagtaacacgtgagcaacctgccttacagagaggaataatgattggaaacggtcactaatacctcataaaatatctatactgcatggtattggatatcaaagatttatcgctgtaagatggg

SEQ ID NO: 539 - DNA, 191 bp, Unknown
  Encodes 16S rRNA from Clostridium XlVa
agagtttgatcatggctcaggatgaacgctagctacaggcttaacacatgcaagtcgaggggaaaccctgatgcagcgacgccgcgtgagtgaagaagtatttcggtatgtaaagctctatcagcagggaagaaaatgacggtacctgactaagaagccccggctaactacgtgccagcagccgcggtaat

SEQ ID NO: 540 - DNA, 225 bp, Unknown
  Encodes 16S rRNA from Asaccharobacter
agagtttgatcctggctcaggatgaacgctggcggcgtgcttaacacatgcaagtcgaacgattaagacccttcggggtgaataaagtggcgaacgggtgagtaacacgtgaccaacctgcctcgcactccggaataccttgtggaaacgcaaactaataccggatactccgagctgagcgcatgctctactcgggaaagcctttacggtgcgagatggggtcgc

SEQ ID NO: 541 - DNA, 225 bp, Unknown
  Encodes 16S rRNA from Blautia
agagtttgatcatggctcaggatgaacgctggcggcgtgcctaacacatgcaagtcgaacggggatatgtcggaatgagacttcggttgaaggaagacatatcttagtggcggacgggtgagtaacgcgtggagaacctgcctcatactgggggataccagtgagaaatcactgctaaaaccgcataagcgcacggtaccgcatggtacagtgtgaaaaactccg

SEQ ID NO: 542 - DNA, 225 bp, Unknown
  Encodes 16S rRNA from Mucilaginibacter
agagtttgatcatggctcaggatgaacgctagcggcaggcctaatacatgcaagtcggacgggatctccccttcgggggagtgagagtggcgcacgggtgcgtaacgcgtatgcaaccaaccctcatccgggggacagccggtggaaacgccgggtaataccccatatccacttcgggaggcatcttctgaggtggaaaggctttggtcggaggaggacgggcat

SEQ ID NO: 543 - DNA, 225 bp, Unknown
  Encodes 16S rRNA from Coprococcus
agagtttgatcatggctcaggatgaacgctggcggcgtgcttaacacatgcaagtcgaacggacttaaggcgctgacgagacttcggtcaaatcttgtcttaagttagtggcggacgggtgagtaacgcgtgggtaacctgccgtatgccgggggacaacagttggaaacgactgctaataccgcataagcgcacggggaggcatctttccgtgtgaaaaactcc

SEQ ID NO: 544 - DNA, 225 bp, Unknown
  Encodes 16S rRNA from Lachnospiracea incertae sedis
agagtttgatcctggctcaggatgaacgctggcggcgtgcttaacacatgcaagtcgaacggaacattccacccgaagaatgaagaagcttgcttcggaatgattcaaccggaatgtttagtggcggacgggtgagtaacgcgtgggtaacctaccttacacagggggataacagttagaaatgactgctaataccgcataagcgcacagtaccgcatggtacgg

SEQ ID NO: 545 - DNA, 225 bp, Unknown
  Encodes 16S rRNA from Butyricimonas
agagtttgatcatggctcaggatgaacgctagcggcaggcttaacacatgcaagtcgaggggcagcgggtctagcaatagatgccggcgaccggcgaaagggtgagtaacgcgtgagcaacatacccttgacagggggataggcactggaaacggtgtgtaataccccgtaatacattccatcgcatggtggggtgttgaaagattcattggtcaaggattggct

SEQ ID NO: 546 - DNA, 225 bp, Unknown
  Encodes 16S rRNA from Lachnospiracea incertae sedis
agagtttgatcatggctcaggatgaacgctggcggcgtgcttaacacatgcaagtcgaacgaagctcctgcgcagatcccttcggggtgaagcaagggaagacttagtggcggacgggtgagtaacgcgtgggtaacctgccatatacagggggataacagttagaaatgactgctaataccccataagcgcacagtaaggcatcttacagtgtgaaaagccttt

SEQ ID NO: 547 - DNA, 225 bp, Unknown
  Encodes 16S rRNA from Treponema
agagtttgatcatggctcagaacgaacgctggcggcgcgtcttaagcatgcaagtcggacgggatatggtagcttgctaccattgagagtggcggactggtgagtaacgcgtgggtgacgtaccctggtgaccgggacagctcctagaaataggaggtaataccggatacgctggatgctgtcagagggcattcaggaaagcagcttttgctgcgcacgaggagc

SEQ ID NO: 548 - DNA, 225 bp, Unknown
  Encodes 16S rRNA from Clostridium sensu stricto
agagtttgatcctggctcaggacgaacgctggcggcgcgcctaacacatgcaagtcgaacgggactagtgactagagtcaagaagttttcttggttctattcactagttcagtggcggacgggtgagtaaagcatgagtaacttgcccattagtggggaatagcttttggaaacagaagataataccgcatacatcggtttggacacatgttcggaccggaaaag

SEQ ID NO: 549 - DNA, 225 bp, Unknown
  Encodes 16S rRNA from Clostridium XlVa
agagtttgatcctggctcaggatgaacgctggcggcgtgcctaacacatgcaagtcgagcggagatagaacaccggatgaagattcgtcggaatccaccgttttatcttagcggcggatgggtgagtaacgcgtggataacctgcccttcacagggggataacaaccggaaacgggtgctaataccgcatgggcgcagggggccgcatggttcccggcgtaaaga

SEQ ID NO: 550 - DNA, 225 bp, Unknown
  Encodes 16S rRNA from Anaerovorax
agagtttgatcatggctcaggatgaacgctggcggcgtgcctaacacatgcaagtcgagcgagaaaggacgaagcagcttgctgcagagtcccggacagcggcggacgggtgagtaacgcgtaggtaagctgccccttgcaggaggatagcctcgggaaaccgggattaatacttcataacgcgtttttatcgcatggtgaaaacgccaaagatttatcggcaag

SEQ ID NO: 551 - DNA, 225 bp, Unknown
  Encodes 16S rRNA from Saccharofermentans
agagtttgatcctggctcaggacgaacgctggcggcgtgcctaacacatgcaagtcgagcggggacactggaggagcttgcttcactggtgttctagcggcggacgggtgagtaacgcgtgaacaatctgtcccggacagggggataacacttggaaacaggtgctaataccgcataagcccacggtaccgcatggtacagggggaaaaggagcgatccggttcg

SEQ ID NO: 552 - DNA, 225 bp, Unknown
  Encodes 16S rRNA from Clostridium XlVa
agagtttgatcatggctcaggatgaacgctggcggcgtgcctaacacatgcaagtcgaacgaagttgtttccacccgacagattatcttcggatatgaagtcaccggaaacgcttagtggcggacgggtgagtaacgcgtgggcaacctgccctacacagggggatagcggttggaaacgaccggtaataccgcatacctttattgaaccgcatgatttaataaa

SEQ ID NO: 553 - DNA, 225 bp, Unknown
  Encodes 16S rRNA from Clostridium III
agagtttgatcatggctcaggataaacgctggcggcgcacataagacatgcaagtcgaacggacgattattaattcttcacgatttaataaaagttagtggcggactggtgagtaacgcgtgagcaacctacctattagaggggaataacgaagagaaattttcgctaataccgcataagctgaaggaatcgcatgattcagtcagaaaaggagcaatccgctaa

SEQ ID NO: 554 - DNA, 225 bp, Unknown
  Encodes 16S rRNA from Clostridium IV
agagtttgatcatggctcaggatgaacgctggcggcgtgcataacacattcaagtcgaacgggcgagagggcttcggtcctcaagtcagtggcggacgggtgagtaacgcgtgagcaacctgcccctatgtgcgggataaccttcggaaacggatgctaataccgcatgaaccaacgggatcgcatggtccagttggcaaagatttattgcatagggatgggctc

SEQ ID NO: 555 - DNA, 225 bp, Unknown
  Encodes 16S rRNA from Ruminococcus
agagtttgatcatggctcaggacgaacgctggcggtatgcttaatacatgcaagtcgaacggagctcagcggaagcttgcttctgcgaaagcttagtggcggacgggtgagtaacgcgtgagtaacctgccttaaagagggggataacacagagaaatctgtgctaataccgcataatgcagcacagccgcatgactatgctgccaaaggtcagccgctttaaga

SEQ ID NO: 556 - DNA, 225 bp, Unknown
  Encodes 16S rRNA from Clostridium XlVa
agagtttgatcctggctcaggatgaacgctggcggcgtgcctaacacatgcaagtcgaacggaaaggattcttcggaattctttcagtggcggacgggtgagtaacgcgtgggtaacctgccccatacaggggaacaacagctggaaacggctgctaataccgcataagcgcacagtactgcatggtacagtgtgaaaagattttatcggtatgggatggacccg

SEQ ID NO: 557 - DNA, 225 bp, Unknown
  Encodes 16S rRNA from Clostridium XI
agagtttgatcatggctcaggacgaacgctggcggcgtgcttaacacatgcaagtcgaacgaggtttactgaagagcttgctctgaggtagaccgagtggcggacgggtgagtaacgcgtgaggaacctgtcttacacagggggataacgcaccgaaaggtgtgctaataccgcataagaccacactttcgcatggaagaggggtcaaaggagcgatccggtgta

SEQ ID NO: 558 - DNA, 225 bp, Unknown
  Encodes 16S rRNA from Clostridium XlVa
agagtttgatcatggctcaggatgaacgctggcggcgtgcctaacacatgcaagtcgagcggagttacataagcttgcttttgtaacttagcggcggatgggtgaggaacgcgtggataacctgcctcgcactgggggataacagctggaaacggctgttaataccgcatatgctcacggtaccgcatggtacagggaggaaagatttatcggtgcgagatggat

SEQ ID NO: 559 - DNA, 225 bp, Unknown
  Encodes 16S rRNA from Eubacterium
agagtttgatcatggctcaggattaacgctggcggcgtgcctaacacatgcaagtcgagcgagaaatggtgaagagaaacttcggttgaacagatccatggacagcggcggacgggtgagtaacgcgtgggcaacctgcccctttccggaggatagccaagggaaactttgaataatactccataaagcaagagtaccgcatgatacacttgccaaagatttatc

SEQ ID NO: 560 - DNA, 225 bp, Unknown
  Encodes 16S rRNA from Lachnospiracea incertae sedis
agagtttgatcatggctcaggatgaacgctggcggcgcgcttaacacatgcaagtcgaacggaatttatagcttcggttgtgaattcagtggcggacgggtgagtaacacgtggataacttgccttttagtgggggatagctgagagaaatctcaattaataccgcataaagtaatttattcgcatgaatagattaataaagatgaaaatcgctaaaagataggt

SEQ ID NO: 561 - DNA, 225 bp, Unknown
  Encodes 16S rRNA from Clostridium IV
agagtttgatcatggctcaggatgaacgctggcggcgtgcataacacattcaagtcgaacgaagcattaagacggaagccttcgggtggaagatttaatgacttagtggcggacgggtgagtaacgcgtgagcaaccttcctgcctgtgagggataacacagggaaacttgtgctaataccgcataaagcatttgagtcgcatggtttaggtgccaaagatttat

SEQ ID NO: 562 - DNA, 225 bp, Unknown
  Encodes 16S rRNA from Ruminococcus
agagtttgatcatggctcaggacgaacgctggcggcacgcttaacacatgcaagtcgaacggtgacggcaacaagcttgcttgttgcaagatcagtggcggacgggtgagtaacacgtgagcaatctgccttcgggtgggggataccagttggaaacgactgttaataccgcataacatgatagaaccgcatgattttatcatcaaagatttattgcctgaagat

SEQ ID NO: 563 - DNA, 225 bp, Unknown
  Encodes 16S rRNA from Clostridium IV
agagtttgatcctggctcaggacgaacgctggcggcgtgcctaacacatgcaagtcgaacggagttattcgagatgaagttttcggatggaattttggataacttagtggcggacgggtgagtaacgcgtgagtaacctgcccataagagggggataacgttctgaaaagaacgctaataccgcataatatatttggttcgcatgaaccgaatatcaaaggagca

SEQ ID NO: 564 - DNA, 225 bp, Unknown
  Encodes 16S rRNA from Faecalibacterium
agagtttgatcatggctcaggataaacgctggcggcgcacataagacatgcaagtcgaacggacccaaatcattcattacgattgatggaaggttagtggcggactggtgagtaacgcgtgagcaacctacctataagaggggaataacagagagaaatttctgctaataccgcataagctgaaagaatcgcatgatttagtcagaaaaggagcaatccgcttat

SEQ ID NO: 565 - DNA, 225 bp, Unknown
  Encodes 16S rRNA from Anaerovibrio
agagtttgatcatggctcaggacgaacgctggcggcgtgcttaacacatgcaagtcgaacggagtgaaggggagcttgctccttggaacttagtggcaaacgggtgagtaacgcgtaggcaacctgcccttcagatggggacaacatttcgaaaggaatgctaataccgaatgacgtgcattggtcgcatgaccgatgtaccaaaggccgggcaaccggtcactg

SEQ ID NO: 566 - DNA, 225 bp, Unknown
  Encodes 16S rRNA from Asaccharobacter
agagtttgatcctggctcaggatgaacgctggcggcgtgcctaacacatgcaagtcgaacggttaagccggcttcggccgggtatagagtggcgaacgggtgagtaacacgtgaccaacctgccccgcgccccgggatagcctcgtgaaaacgggattaacaccggatgcgccgcgggccccgcatggggcccgcgggaaagcttggcggcgcgggatggggtcg

SEQ ID NO: 567 - DNA, 225 bp, Unknown
  Encodes 16S rRNA from Pelotomaculum
agagtttgatcctggctcaggacaaacgctggcggcgtgcttaacacatgcaagtcgtacggagctgcaggacggaatccttcgggaggaagaacggcagcttagtggcggacgggtgagtaacgcgtgagcaacctgcccataagagggggataacagttggaaacgactgctaataccgcataagaccacaacaccgcatggtggaggggtcaaagagcaatc

SEQ ID NO: 568 - DNA, 225 bp, Unknown
  Encodes 16S rRNA from Spirochaeta
agagtttgatcatggctcagaacgaacgctggcggcgcgtcttaagcatgcaagtcgagcgggaaggtgtagcttgctacgccggagagcggcggactggtgagtaacacgtgggtaacgcacccttctgacggggacagcctgtggaaacacagggtaataccggatgagatgtgcttctggaagggggcacatgaaaggagctacggctccgcagggggaacg

SEQ ID NO: 569 - DNA, 225 bp, Unknown
  Encodes 16S rRNA from Prevotella
agagtttgatcatggctcaggatgaacgctagctacaggcttaacacatgcaagtcgaggggcagcatgtcgtgtgcttgcacacgatgatggcgaccggcgcacgggtgagtaacgcgtatccaacctgcccatgactccgggatagcccgctgaaaagcggattaacaccggatgtggtcgaaagaggacatctgatttcgaccaaagcttcggcggtcatgg

SEQ ID NO: 570 - DNA, 225 bp, Unknown
  Encodes 16S rRNA from Lachnospiracea incertae sedis
agagtttgatcatggctcaggatgaacgctggcggcgtgcttaacacatgcaagtcgaacgaagcacctctcccgaagattgaagtagcttgctacggattgattcatttgaggtgacttagtggcggacgggtgagtaacgcgtgggtaacctgcctcatagagggggacaacagttggaaacgactgctaataccgcataacatgtgactgtcacatgacaga

SEQ ID NO: 571 - DNA, 225 bp, Unknown
  Encodes 16S rRNA from Anaerovorax
agagtttgatcatggctcaggatgaacgctggcggcgtgcttaacacatgcaagtcgagcgagaaacctacagatgacgcttcggttgattcagtaggcggaaagcggcggacgggtgagtaacgcgtaggcaacctgcccctggcagagggatagcatcgggaaactgatattaagacctcataacgcatcgatatcacatgataatgatgccaaagatttatc

SEQ ID NO: 572 - DNA, 225 bp, Unknown
  Encodes 16S rRNA from Clostridium IV
agagtttgatcatggctcaggattaacgctggcggcgtgcataacacattcaagtcgaacggacgaagcccttcggggcctagttagtggcggacgggtgagtaacgcgtgagcaacctgcccttatgtgggggataacgaccggaaacggtcgctaataccgcatgacccgatagtatcgcatgatacagtcggcaaagatttattgcataaggatgggctcgc

SEQ ID NO: 573 - DNA, 225 bp, Unknown
  Encodes 16S rRNA from Victivallis
agagtttgatcctggctcagaacgaacgctggcggcatggattaggcatgcaagtcgaacgaggtagcaataccgagtggcggaagggtgaggaacgcgtgagtaatctgccccctagttgggaataacagttggaaacgactgctaataccgaatgtggctttcaggtcgcatgacttgaaggctaaagatttatcgctaggggatgagctcgcgtcccattag

SEQ ID NO: 574 - DNA, 184 bp, Unknown
  Encodes 16S rRNA from Syntrophococcus
agagtttgatcatggctcaggatgaacgctggcggcgtgctttgcacaatgggggaaaccctgatgcagcgacgccgcgtgagtgatgaagtatttcggtatgtaaagctctatcagcagggaagaagatgacggtacctgagtaagaagccccggctaactacgtgccagcagccgcggtaat

SEQ ID NO: 575 - DNA, 225 bp, Unknown
  Encodes 16S rRNA from Syntrophococcus
agagtttgatcctggctcaggatgaacgctagctacaggcttaacacatgcaagtcgagcgaagcgcagaaacggatttcttcggattgaaggttctgtgactgagcggcggacgggtgagtaacgcgtggggaacctgccctgtaccgggggataacagacagaaatgtctgctaataccgcataagcgcacgagaaggcatcttcttgtgtgaaaaactccgg

SEQ ID NO: 576 - DNA, 225 bp, Unknown
  Encodes 16S rRNA from Desulfovibrio
agagtttgatcatggctcagattgaacgctggcggcgtgcttaacacatgcaagtcgaacgcgaaaggggcttcggtcccgagtagagtggcgcacgggtgagtaacgcgtggatgatctgcccctgcagctggaatagcgactggaaacggtcgataataccggatacgcccttgttgaacgatgaggggaaaggagacctctgcttgcaagtttccgtgcagg

SEQ ID NO: 577 - DNA, 225 bp, Unknown
  Encodes 16S rRNA from Lachnospiracea incertae sedis
agagtttgatcatggctcaggatgaacgctggcggcgtgcttaacacatgcaagtcgaacgaagctcttacgacggatctcttcggagtgaagatgtttgagacttagtggcggacgggtgagtaacgcgtgggtaacctgccccatagagggggacaacagttggaaacgactgctaataccgcatagtaagagaaattcgcatgtttttctcttgaaagcttt

SEQ ID NO: 578 - DNA, 225 bp, Unknown
  Encodes 16S rRNA from Lachnospiracea incertae sedis
agagtttgatcctggctcaggatgaacgctggcggcgtgcttaacacatgcaagtcgaacggagtgtcatttcttcggataggacacttagtggcggacgggtgagtaacgcgtgggtaacctgcctcacacagggggatagcagttggaaacgactgataataccgcataagcgcacagtatcgcatggtacagtgtgaaaaactccggtggtgtgagatggac

SEQ ID NO: 579 - DNA, 225 bp, Unknown
  Encodes 16S rRNA from Clostridium IV
agagtttgatcatggctcaggacgaacgctggcggcgcgcctaacacatgcaagtcgaacggagagtggtttttgattccttcgggatgattattccatttcttagtggcggacgggtgagtaacacgtgagcaacctgccttgcagtgggggataacggttggaaacgatcgctaatacctcataatatatgattgtcgcatggctttcatatcaaagtttttt

SEQ ID NO: 580 - DNA, 204 bp, Unknown
  Encodes 16S rRNA from Prevotella
agagtttgatcctggctcaggatgaacgctagctacaggctttggtcaatgggcgagagcctgaaccagccaagtagcgtgcaggatgacggccctatgggttgtaaactgcttttatacggggataaagtgagggacgtgtccctttttgtaggtaccgtatgaataaggaccggctaattccgtgccagcagccgcggtaat

SEQ ID NO: 581 - DNA, 225 bp, Unknown
  Encodes 16S rRNA from Victivallis
agagtttgatcctggctcagaatgaacgctggcggcatggattaggcatgcaagtcgaacgagaaagcggcttcggccgcgagtaaagtggcgaaagggtgagtaacacgtgaggaacctgccccctggcccggaacaagcctgtgaaaacgggtctgaaaccggatgaggccccctcccgcatgggggggaagccaaatattcatagccaagggatggcctcgc

SEQ ID NO: 582 - DNA, 225 bp, Unknown
  Encodes 16S rRNA from Clostridium XlVa
agagtttgatcctggctcaggatgaacgctggcggcgtgcttaacacatgcaagtcgaacgaagcatagcttgtgaatttcttcggattgaagcagttatgactgagtggcggacgggtgagtaacgcgtgggtaacctgccttacacagggggacaacagagggaaacctctgctaataccgcataacccgctagggccgcatggcccggacggaaaagattta

SEQ ID NO: 583 - DNA, 225 bp, Unknown
  Encodes 16S rRNA from Selenomonas
agagtttgatcatggctcaggacgaacgctggcggcgtgcttaacacatgcaagtcgaacggggcgattgaaagcttgcttttgagagcctagtggcaaacgggtgagtaacgcgtaggcaacctgcctttgggatggggacaacaggacgaaagccctgctaataccgaatgaagtattcttcctgcatgggaaggatatgaaagatggcctctgaaaatgcta

SEQ ID NO: 584 - DNA, 225 bp, Unknown
  Encodes 16S rRNA from Bacteroides
agagtttgatcatggctcaggatgaacgctagcgacaggcctaacacatgcaagtcgaggggcagcgagttggtagcaataccgatgtcggcgaccggcgcacgggtgcgtaacaggtgtgcaatctgtccatagtcggaggatagcccggtgaaaaccgaattaatactccatgtgtcattaaatcgcatgttttgatgatgaaacgtaaggactatggttgag

SEQ ID NO: 585 - DNA, 225 bp, Unknown
  Encodes 16S rRNA from Clostridium XlVa
agagtttgatcatggctcaggatgaacgctggcggcgtgcctaacacatgcaagtcgaacgggacttttaccgacggagattcgtcaaagttggtttaagtctagtggcggacgggtgagtaacgcgtggagaacctgccctttaccgggggataacagagggaagcttctgctaataccgcataagcgcacagtaccgcatggtacagtgtgaaaaactccggt

SEQ ID NO: 586 - DNA, 225 bp, Unknown
  Encodes 16S rRNA from Eggerthella
agagtttgatcctggctcaggatgaacgctggcggcgtgcttaacacatgcaagtcgaacgattaacccatcttcggatggttataaagtggcgaacgggtgagtaacacgtgaccaacctacctttcacattgggataactaagggaaactgtagctaataccaaatactccgggtatccggcatcggaaacccgggaaagctccggcggtgaaagatggggtc

SEQ ID NO: 587 - DNA, 150 bp, Unknown
  Encodes 16S rRNA from Selenomonas
agagtttgatcatggctcaggatgaacgctagctacaggcttaacacatgcaagtcgaggggacgaatgtacgggatgaaaatattgttctgtaatgacggtacctgacgaggaagccacggctaactacgtgccagcagccgcggtaat

SEQ ID NO: 588 - DNA, 225 bp, Unknown
  Encodes 16S rRNA from Mogibacterium
agagtttgatcctggctcaggatgaacgctggcggcgtgcctaatacatgcaagtcgagcgagaagcttctttgaagattcttcggatgattctgtgaagtggaaagcggcggacgggtgagtaacgcgtaggcaacctgcccctgacagagggatagccattggaaacgatgattaaaacctcataatgccgaaagagcacatgcacttacggccaaagattta

SEQ ID NO: 589 - DNA, 225 bp, Unknown
  Encodes 16S rRNA from unknown taxa
agagtttgatcctggctcaggacgaacgcttgcgacgtgcctaagaaatgcaagtcgagcgatgacgggggcttcggctccttgattagcggcgaacggtcgcgtaacacgtaagcaatctgccccaaagtttgggatagccatccgaaaggatgattaataccggatgtggaacataaatcgcatgttttatgttctaaagcagcgatgcgctttgggatgagc

SEQ ID NO: 590 - DNA, 225 bp, Unknown
  Encodes 16S rRNA from Clostridium XlVa
agagtttgatcatggctcaggatgaacgctggcggcgtgcctaacacatgcaagtcgaacggaccttttacagactgcgattcgtcaaaggacgtttaaggttagtggcggacgggtgagtaacgcgtgggtaacctgcctcatagagggggataacagtttgaaaagactgctaataccgcataagcccacaggaccgcatggtccagggggaaaagattcatc

SEQ ID NO: 591 - DNA, 225 bp, Unknown
  Encodes 16S rRNA from Victivallis
agagtttgatcctggctcagaacgaacgctggcggcatggattaggcatgcaagtcgaacgaagtagcaatacttagtggcgcaagggtgaggaacgcgtgagtgacctacccgcaagtttggaacagctcctggaaacgggaattaataccggatgtgatcaatgagctgcatggtttattgattaaagcagtaatgcgcttgcggatgggctcgcgtcccatt

SEQ ID NO: 592 - DNA, 225 bp, Unknown
  Encodes 16S rRNA from Paraprevotella
agagtttgatcatggctcaggatgaacgctagctacaggcttaacacatgcaagtcgaggggcatcacgtggcagcaatgtcatggtggcgaccggcgcacgggtgagtaacgcgtatccgacctggccttcactccgggacagccctccgaaagggggattaatccgggatgtgtggagaagtcgcatggaatctccatgaaagattcatcggtgaaggatggg

SEQ ID NO: 593 - DNA, 225 bp, Unknown
  Encodes 16S rRNA from Brevundimonas
agagtttgatcatggctcaggacgaacgctggcggtgtgcctcatacatgcaagtcgaacgataaggcttcttcggaagtacataagtggcggacgggtgagtacaacataggaaatctgccttaagctgggggacaacagagggaaactcctgctaataccccatatgagctaacttgaaatagttatcttgaaagctccggcggcttaagatgagcctgtgcc

SEQ ID NO: 594 - DNA, 225 bp, Unknown
  Encodes 16S rRNA from Prevotella
agagtttgatcatggctcaggatgaacgctagctacaggcttaacacatgcaagtcgaggggcagcgctggggttgcttgcaacccctggcggcgaccggcgcacgggtgagtaacgcgtatccaacctgcccccaaccgccgcacagcccgccgaaaggcggattaattcggcatgaggtccggcgacggcatcatatccggacgaaaggtattttaccggttg

SEQ ID NO: 595 - DNA, 225 bp, Unknown
  Encodes 16S rRNA from Prevotella
agagtttgatcatggctcaggatgaacgctagctacaggcttaacacatgcaagtcgaggggtaacgtgagagaagcttgcttctcttgacgacgaccggcgaatgggtgagtaacgcgtatccaacctgccgcacgcccgggaacagcccttggaaacgaggattaaatcccgataccttattattccgcatggagaaataagaaaacaggcatgcgatgggga

SEQ ID NO: 596 - DNA, 210 bp, Unknown
  Encodes 16S rRNA from Robinsoniella
agagtttgatcatggctcaggacgaacgctggcggcgtgcttaacacatgcaagtcgaacggggatattgcacaatgggcggaagcctgatgcagcgacgccgcgtgaaggaagaagtatttcggtatgtaaacttctatcagcggggaagaagatgacggtacccgactaagaagccccggctaactacgtgccagcagccgcggtaat

SEQ ID NO: 597 - DNA, 225 bp, Unknown
  Encodes 16S rRNA from Clostridium III
agagtttgatcatggctcaggacgaacgctggcggcgtgcctaacacatgcaagtcgaacgggattccatcgaatgaggcttcggcggattttggtggacatctagtggcggacgggtgagtaacgcgtgagcaacctgcctttaagagggggataacataccgaaaggtatgctaataccgcataagatattagtaccgcatgatacagatatcaaagatttca

SEQ ID NO: 598 - DNA, 225 bp, Unknown
  Encodes 16S rRNA from Butyricimonas
agagtttgatcatggctcaggatgaacgctagcggcaggcttaacacatgcaagtcgaggggcagcgggtctagcaatagatgccggcgaccggcgaaagggtgagtaacgcgtgagcaacatacccttgacagggggataggcactggaaacggtgtgtaataccccgtaacacattccgccgcatgacgggatgttgaaagattgattggtcaaggattggct

SEQ ID NO: 599 - DNA, 225 bp, Unknown
  Encodes 16S rRNA from Spirochaeta
agagtttgatcctggctcagaacgaacgctggcggcgcgtcttaagcatgcaagtcgagcggtaaggaggtagcttgctacttccctagagcggcggactggtgagtaacgcgtgggtgacgtaccctttggttggggatagccggtagaaataccgggtaataccgaataagacctctagtagaaagattagagaggaaagcggctccggccgcgccgaaggaa

SEQ ID NO: 600 - DNA, 225 bp, Unknown
  Encodes 16S rRNA from Hydrogenoanaerobacterium
agagtttgatcatggctcaggatgaacgctggcggcgtgcctaacacatgcaagtcgaacggaactttttacgagcaaggcttcggccaagcaagtttcaagtttagtggcggacgggtgagtaacgcgtgagcaacctgcctttcagagggggataacgtttggaaacgaacgctaataccgcataacgtatggaaatcgcatggtaaccataccaaagatttt

SEQ ID NO: 601 - DNA, 225 bp, Unknown
  Encodes 16S rRNA from Proteiniclasticum
agagtttgatcatggctcaggacgaacgctggcggcgtgcctaacacatgcaagtcgagcggggacaaaactggaagggtttcggcctggaaggaaatgttccagcggcggacgggtgagtaacgcgtgaacaatctgtcccagacagggggataacagatggaaacatctgctaataccgcataagaccacgaggcgacatcgccttgaggtaaaaggaggaat

SEQ ID NO: 602 - DNA, 225 bp, Unknown
  Encodes 16S rRNA from Roseburia
agagtttgatcatggctcaggatgaacgctggcggcgtgcttaacacatgcaagtcgaacgaattttttacagaaggaagcttcggccgacggacgtaagaagtgagtggcggacgggtgagtaacgcgtgggtaacctgcctcacatcgggggataccagtcggaaacgactgctaaaaccgcataagaccacggtatcgcatgatactgaggccaaaactccg

SEQ ID NO: 603 - DNA, 225 bp, Unknown
  Encodes 16S rRNA from Clostridium XlVa
agagtttgatcctggctcaggatgaacgctggcggcgtgcctaacacatgcaagtcgaacgaagaccccgaagcggagatttcggttgaagctaagggaggactgagtggcggacgggtgagtaacgcgtggataacctgccccatacagggggatagcagttggaaacgactgataataccgcataagcgcacggagagacatctctttgtgtgaaaagattta

SEQ ID NO: 604 - DNA, 225 bp, Unknown
  Encodes 16S rRNA from Anaerofustis
agagtttgatcatggctcaggacgaacgctggcggcgtgcttaacacatgcaagtcgaacgggaagctttgacaagttttactttgatgagtggacagtggcgaacgggtgagtaacgcgtaggtaaccaaccttatgctgggggatagcctttggaaacgaagagtaataccgcataagaccacactgccgcatggcagaggggtaaaagatttattggcatga

SEQ ID NO: 605 - DNA, 225 bp, Unknown
  Encodes 16S rRNA from Succiniclasticum
agagtttgatcatggctcaggacgaacgctggcggcgtgcctaacacatgcaagtcgaacggggattttgtttcggcagaatcctagtggcgatcggtagccggtctgagaggatgaacggccacattgggactgagacacggcccagactcctacgggaggcagcagtggggaatcttccgcaatgggcgcaagcctgacggagcaacgccgcgtgagtgagga

SEQ ID NO: 606 - DNA, 225 bp, Unknown
  Encodes 16S rRNA from Anaeroplasma
agagtttgatcctggctcaggattaacgctggcggcgtgcctaatacatgcaagtcgaatggtggtagcaatacaaaccatggcgaacgggtgagtaacacgtaggtaacctatcttactgacgaggataaccgttggaaacgacggataatactggataggacatcacaaagggcatccttagatgtttaaaggagcaatccacggtaagaggggcctgcggcg

SEQ ID NO: 607 - DNA, 225 bp, Unknown
  Encodes 16S rRNA from Oscillibacter
agagtttgatcatggctcaggacgaacgctggcggcgtgcctaacgatcagtagccggactgagaggttgaacggccacattgggactgagatacggcccagactcctacgggaggcagcagtggggaatattgggcaatgggggcaaccctgacccagcaacgccgcgtgaaggaagaaggctttcgggttgtaaacttcttttaccgaggacgaagaacgtga

SEQ ID NO: 608 - DNA, 225 bp, Unknown
  Encodes 16S rRNA from Escherichia/Shigella
agagtttgatcatggctcagattgaacgctggcggcaggcctaacacatgcaagtcgaacggtaacaggaagaagcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtg

SEQ ID NO: 609 - DNA, 225 bp, Unknown
  Encodes 16S rRNA from Bacteroides
agagtttgatcctggctcaggatgaacgctagcgacaggcctaacacatgcaagtcgaggggcagcgagtttgtagcaatacagatgtcggcgaccggcgcacgggtgcgtaacaggtgtgcaacctggcctataccaagggatagcccgctgaaaggcggattaatactttataagttgtgatgaggcatctcattataatgaaacgttagggtataggatggg

SEQ ID NO: 610 - DNA, 225 bp, Unknown
  Encodes 16S rRNA from Clostridium XlVa
agagtttgatcctggctcaggatgaacgctggcggcgtgcctaacacatgcaagtcgagcggggacgcgccaaagaggatgattcgtctgattcttagcgcgtcttagcggcggatgggtgagtaacgcgtggacaacctgcccgcaacagggggataacagctggaaacggctgataataccgcatatgcacacggttccgcatgggactgggtggaaagattt

SEQ ID NO: 611 - DNA, 225 bp, Unknown
  Encodes 16S rRNA from Clostridium XlVa
agagtttgatcatggctcaggatgaacgctggcggcgtgcctaacacatgcaagtcgaacggtgaaagaagacggaagccttcgggcggaagttttttggatcagtggcggacgggtgagtaacgcgtggataacctgcctcatacagggggataacagggagaaatcactgctaataccgcataagcgcacaggaccgcatggtctggtgtgaaaaactccggt

SEQ ID NO: 612 - DNA, 225 bp, Unknown
  Encodes 16S rRNA from Clostridium IV
agagtttgatcatggctcaggatgaacgctggcggcgtgcataacacattcaagtcgaacgaagcactggcgaggaagtcttcggatggaattgcttttgacttagtggcggacgggtgagtaacgcgtgagcaaccttcctggcagtgagggataacacagggaaacttgtgctaataccgcatgacgcacgattgtcgcatggcagacgtgccaaagattaat

SEQ ID NO: 613 - DNA, 225 bp, Unknown
  Encodes 16S rRNA from Clostridium III
agagtttgatcatggctcaggacgaacgctggcggcgcgcttaacacatgcaagtcgaacggtgaaggtgcttcggcaccggatcagtggcggacgggtgagtaacacgtgagcaacctgcccttcagagggggataacattgagaaatcagtgctaataccgcataagaccacagtaaggcatcttacaggggtcaaaggagcaatccgctgaaggatgggctc

SEQ ID NO: 614 - DNA, 225 bp, Unknown
  Encodes 16S rRNA from Prevotella
agagtttgatcctggctcaggatgaacgctagctacaggcttaacacatgcaagtcgaggggcagcatgtcgtgtgcttgcacacgatgatggcgaccggcgcacgggtgagtaacgcgtatccaacctgcccatgaccccgggatagcccgctgaaaagcggattaacaccggatgcggtcgaaagaggacatctgatttcgaccaaagcttcggcggtcatgg

SEQ ID NO: 615 - DNA, 225 bp, Unknown
  Encodes 16S rRNA from Coprococcus
agagtttgatcatggctcaggatgaacgctggcggcgtgcttaacacatgcaagtcgaacgaagcacttaggacagatttcttcggattgacgacctaattgacttagtggcgaacgggtgagtaacgcgtgggtaacctgcctcatgcagggggataacaattagaaatgattgctaataccgcataagaccgcggtaccgcatggtacagcggccaaagattt

SEQ ID NO: 616 - DNA, 225 bp, Unknown
  Encodes 16S rRNA from Oscillibacter
agagtttgatcatggctcaggacgaacgctggcggcgtgcctaacacatgcaagtcgaacggaactctttggaacaaggcttcggccaagggaatttgagtttagtggcggacgggtgagtaacgcgtgagcaacctgcccttcggagggggacaacagttggaaacgactgctaataccgcatgacatacagagatcgcatggtcattgtatcaaagatttatc

SEQ ID NO: 617 - DNA, 225 bp, Unknown
  Encodes 16S rRNA from Parabacteroides
agagtttgatcctggctcaggatgaacgctagcgacaggcttaacacatgcaagtcgaggggcagcgtggcggcagcaatgccgccgacggcgaccggcgcactggtgagtaacacgtatgcaacctgccccccacagggggacaatccagagaaatttggtctaataccgcataagagcgtccccggcatcggggttgcttgaaagcaatttgcggtgggggat

SEQ ID NO: 618 - DNA, 225 bp, Unknown
  Encodes 16S rRNA from Bacteroides
agagtttgatcctggctcaggatgaacgctagctacaggcttaacacatgcaagtcgaggggcagcatgggggaggtttcggccacccccgatggcgaccggcggatgggtgagtaacgcgtatccaacctgcccctgtcccggggacagcccttagaaatgaggattaacccccgatggcgcggaggggccgcatggcttttccgccaaatgcgaaggacaggg

SEQ ID NO: 619 - DNA, 225 bp, Unknown
  Encodes 16S rRNA from Mogibacterium
agagtttgatcctggctcaggatgaacgctggcggcgtgcctaatacatgcaagtcgagcgagaaatctttcagacgattcttcggatgagtcaggaagatggaaagcggcggacgggtgagtaacgcgtaggcaacctgccctcagcagagggatagccattggaaacgatgattaaaacctcataatgctgcagtaacacatgttacagcagccaaagattta

SEQ ID NO: 620 - DNA, 225 bp, Unknown
  Encodes 16S rRNA from Solobacterium
agagtttgatcatggctcaggatgaacgctggcggcgtgcctaatacatgcaagtcgatcgcgtcatgtagcttcggttatatgatgagaggcgaacgggtgagtaatacataagcaacctgcccacggagaccgggataacccctggaaacggggactaagaccggataggcaaaatgaaggcatcttcattatgttaaaggagaaagacactggtggatgggc

SEQ ID NO: 621 - DNA, 225 bp, Unknown
  Encodes 16S rRNA from Bacteroides
agagtttgatcatggctcaggatgaacgctagctacaggcctaacacatgcaagtcgcggggcagcattgaggtagcaatacttcagatggcgaccggcgcacgggtgcgtaacgcgtatccaacctggcccttactcgggtatagccctgcgaaagtaggattaatccccgatgttgtcaagatggagccttttttcttgaccaaaggtttatgtcggtaaggg

SEQ ID NO: 622 - DNA, 225 bp, Unknown
  Encodes 16S rRNA from Clostridium III
agagtttgatcctggctcaggacgaacgctggcggcgtgcttaatccatgcaagtcgaacggggcgattccggaaagtcttcggaccggaagggagagcttagtggcgaacgggtgagtaacgcgtgaccaaccaaccttaagcagggggacaacagctggaaacggctgctaataccgcataagaccacagtggggcatcctacaggggtcaaaggagcaatcc

SEQ ID NO: 623 - DNA, 225 bp, Unknown
  Encodes 16S rRNA from Victivallis
agagtttgatcctggctcagaacgaacgctggcggcatggattaggcatgcaagtcgaacggtgcagcaatgcacagtggcgcaagggtgaggaacgcgtgagtaatctgccctcaagttgggaacagcttctggaaacggaaattaataccgaatgtgatctttgggaggcatctttcaaagattaaaggccgcaaggtcgcttgaggaggggctcgcgtccca

SEQ ID NO: 624 - DNA, 225 bp, Unknown
  Encodes 16S rRNA from Saccharofermentans
agagtttgatcatggctcaggacgaacgctggcggcgtgcctaacacatgcaagtcgagcggaggatgtgaagaagcttgcttcattgcattctcagcggcggacgggtgagtaacgcgtgagcaacctggccttcacagggggataagacggcgaaagcggttctaataccccatatgaccacactgtcacatggcagaggggtgaaaggagcaatccggtgaa

SEQ ID NO: 625 - DNA, 225 bp, Unknown
  Encodes 16S rRNA from Saccharofermentans
agagtttgatcatggctcaggacgaacgctggcggcgtgcctaacacatgcaagtcgagcggacggaggggcttcggccccgaagtcagcggcggacgggtgagtaacgcgtgagcaatctgtcccggacagggggataacacttggaaacaggtgctaataccgcataagaccacgagggggcatccttttgaggtaaaaggaggaatccggtccggggtgagt

SEQ ID NO: 626 - DNA, 225 bp, Unknown
  Encodes 16S rRNA from Olivibacter
agagtttgatcatggctcaggatgaacgctagcggcaggcctaatacatgcaagtcgtacggtaaacggtccttcgggaccgtgagagtggcggacgggtgcgtaacgcgtatgcaaccaacccccctcgccgggatagccggtggaaacgccggataataccggatgcgccgcgtgggaggcatctcccgagcggcaaggcggagacgcggagggggacgggca

SEQ ID NO: 627 - DNA, 225 bp, Unknown
  Encodes 16S rRNA from Thermotalea
agagtttgatcatggctcaggatgaacgctggcggcgtgcctaacacatgcaagtcgagcgggaatctcctgattgaaacttcggtagattgacggggaggatagcggcggacgggtgagtaacgcgtaggtaagctgccctatgcacagggatagcctagggaaacctggattaatacctgatgacgctgcgaggtcacatggccatgcagccaaagttttttc

SEQ ID NO: 628 - DNA, 225 bp, Unknown
  Encodes 16S rRNA from Proteiniclasticum
agagtttgatcatggctcaggacgaacgctggcggtatgcctaacacatgcaagtcgaacgaaaaaagagagcttgctttcttttttagtggcgcacgggtgagtaacgcgtgagtaatctgccttaaagtgggggacaacatttggaaacgaatgctaataccgcgtaatatgcagttttcgcatgaattttgtattatagatttatcgctttaagatgagctc

SEQ ID NO: 629 - DNA, 225 bp, Unknown
  Encodes 16S rRNA from Clostridium III
agagtttgatcatggctcaggacgaacgctggcggcgtgcctaacacatgcaagtcgaacgagaaatgatgattagattccttcgggatgaaaagattcatggacagtggcggacgggcgagtaacgcgtgagtaacctgcccataagagagggatagccgatggaaacgtcgagtaatacctcatattgtaattaattcgcatggattgattatgaaagattta

SEQ ID NO: 630 - DNA, 225 bp, Unknown
  Encodes 16S rRNA from Anaeroplasma
agagtttgatcctggctcaggattaacgctggcggcatgcctaatacatgcaagtcgaatgagaagcttgcttctcatggcgaacgggtgagtaacacgtaggtaacctgccttacactcgaggataaccgttggaaacgacggataatactggataggacagagattcgcatgagactctgtttaaaagcgatggtgtatgaggggcctgcggtgcattagcta

SEQ ID NO: 631 - DNA, 225 bp, Unknown
  Encodes 16S rRNA from Treponema
agagtttgatcatggctcagaacgaacgctggcggcgcgtcttaagcatgcaagtcgagcggcaaggaaggagcttgcttcttccctagagcggcggactggtgagtaacgcgtgggtgacgtaccctccggacggggacagcctgtggaaacacaggataataccggatacggtgcatgttgtcagaggacatgcaggaaaggttcttttgaaccgccggagga

SEQ ID NO: 632 - DNA, 225 bp, Unknown
  Encodes 16S rRNA from Clostridium XlVa
agagtttgatcatggctcaggatgaacgctggcggcgtgcttaatacatgcaagtcgaacggggatgtccacccgatgaggccggagtgcttgcacaaaggccgattcaaccggatatcctagtggcggacgggtgagtaacgcgtgggtaacctgccttatacaggggaataacagtcagaaatggctgctaataccgcataagcgcacgaggccgcatggcca

SEQ ID NO: 633 - DNA, 225 bp, Unknown
  Encodes 16S rRNA from Clostridium III
agagtttgatcatggctcaggacgaacgctggcggcgcgcctaacacatgcaagtcgaacgggactagtgaccggagtgcagagaggatctgtattgcgatcactagttcagtggcggacgggtgagtaaagcatgagcaacctggctactagagggggatagcttttggaaacagaagataataccgcatacatcaaagatttcgcatgagatttttggaaaag

SEQ ID NO: 634 - DNA, 225 bp, Unknown
  Encodes 16S rRNA from Desulfotomaculum
agagtttgatcatggctcaggacgaacgctggcggcgtgcttaatacatgcaagtcgaacggagattatgatttcggttgtaatcttagtggcgaacgggtgagtaacgcgtgaacaacctgactcagagtgggggataacaacgggaaactgttgctaataccgcataagaccacatttccgcatgggagaggggtcaaagatttatcgctttgagaggggttc

SEQ ID NO: 635 - DNA, 225 bp, Unknown
  Encodes 16S rRNA from Bacillus
agagtttgatcctggctcaggatgaacgctggcggcgtgcctaatacatgcaagtcgatcgggagtagcaatacttcagaggcgtacgggtgagtaacacatagggaacctgcccttaagactgggatacccagacgaaagtttggctaataccggataacaacagaggtcgcatgacctttgcttgaaaggcgctctcaagcgccacttttggatggccctgtg

SEQ ID NO: 636 - DNA, 225 bp, Unknown
  Encodes 16S rRNA from Anaerovorax
agagtttgatcatggctcaggatgaacgctggcggcgtgcctaacacatgcaagtcgagcgggaaatcgctgattgagatttcggttgattgaagcgatggatagcggcggacgggtgagtaacgcgtaggtaatctgccttcagcacagggatagcctagggaaacctggattaatacctgataatgcagtttggtcacatggccagattgccaaagatttatc

SEQ ID NO: 637 - DNA, 191 bp, Unknown
  Encodes 16S rRNA from Ruminococcus
agagtttgatcatggctcaggatgaacgctagctacaggcttaacacatgcaagtcgaggggaaaccctgatgcagcgatgccgcgtggaggaagaaggttttcggattgtaaactcctgtcttaaaggacgataatgacggtactttaggaggaagctccggctaactacgtgccagcagccgcggtaat

SEQ ID NO: 638 - DNA, 225 bp, Unknown
  Encodes 16S rRNA from Agarivorans
agagtttgatcatggctcagattgaacgctggcggcaggcttaacacatgcaagtcgtacggtaacagagggggaatattgcacaatgggggaaaccctgatgcagccatgccgcgtgtgtgaagaaggccttcgggttgtaaagcacttttgcattcgaggaagacagcacgtaaataaacgtgttatttgacgttagagtgtgaataagcaccggcaaactcc

SEQ ID NO: 639 - DNA, 225 bp, Unknown
  Encodes 16S rRNA from Anaerotruncus
agagtttgatcatggctcaggacgaacgctggcggcgcgcttaacacatgcaagtcgaacggagcttgcttttgaaggtccttcgggaacggatgttgcaagcttagtggcggacgggtgagtaacgcgtgagcaacctgcctttcagagggggataacacaacgaaagctgtgctaataccgcatgacattgcgacaccgcatggtgatgcaatcaaaggagca

SEQ ID NO: 640 - DNA, 225 bp, Unknown
  Encodes 16S rRNA from Papillibacter
agagtttgatcatggctcaggatgaacgctggcggcgtgcataacacattcaagtcgaacggacgacagggggcttgctccctgaagtcagtggcggacgggtgagtaacgcgtgagcaacctgccttggtctgcgggataacattgggaaaccggtgctaataccgcataacgcatcgagatcacatggtcatgatgccaaagaagcaatttggaacaagatgg

SEQ ID NO: 641 - DNA, 185 bp, Unknown
  Encodes 16S rRNA from Clostridium XlVa
agagtttgatcctggctcaggatgaacgctggcggcgtgcttatgcacaatgggggaaaccctgatgcagcgacgccgcgtgagcgatgaagtatttcggtatgtaaagctctatcagcagggaagaaaatgacggtacctgactaagaagcaccggctaaatacgtgccagcagccgcggtaat

SEQ ID NO: 642 - DNA, 225 bp, Unknown
  Encodes 16S rRNA from Clostridium III
agagtttgatcatggctcaggacgaacgctggcggcgtgcctaacacatgcaagtcgagcgatgatcagaagatgaggccctcgggcggattcttctgagattagcggcggatgggtgagtaacgcgtgggcaatctgccctccacagggggataacacagggaaacttgtgctaataccgcataacatctttttaaggcatcttaggaagatcaaaggagcgat

SEQ ID NO: 643 - DNA, 225 bp, Unknown
  Encodes 16S rRNA from Bacteroides
agagtttgatcatggctcaggatgaacgctagcggcaggcttaacacatgcaagtcgaggggcagcggagaagtagcaatacttctgccggcgaccggcgcacgggtgagtaacgcgtatgcaacctttcccagacagggggatagcccagggaaacttggattaataccccgtaagccagaagagggcatcctcgtctggttaaagttccggcggtctggggtg

SEQ ID NO: 644 - DNA, 225 bp, Unknown
  Encodes 16S rRNA from Clostridium XlVa
agagtttgatcctggctcaggatgaacgctggcggcgtgcctaacacatgcaagtcgaacgagcacttcggtgcgagtggcggacgggtgagtaacgcgtgggtaacctgccttacacagggggacaacagttggaaacgactgctaataccgcataagcccacggtaccgcatggtactgtgagaaaagatttatcggtgtaagatggacccgcgtctgattag

SEQ ID NO: 645 - DNA, 225 bp, Unknown
  Encodes 16S rRNA from Ruminococcus
agagtttgatcatggctcaggacgaacgctggcggcacgcttaacacatgcaagtcgaacggagttgatgacttcggttattaacttagtggcggacgggtgagtaacacgtgagcaacctgccttacagagaggaataatgactggaaacggtcactaatacctcataaaatatttagatcgcatggtttggatatcaaagatttatcgctgtaagatgggctc

SEQ ID NO: 646 - DNA, 225 bp, Unknown
  Encodes 16S rRNA from Clostridium XlVa
agagtttgatcatggctcaggatgaacgctggcggcgtgcctaacacatgcaagtcgaacgaagccctacaagtggagatttcggttgaagcgaggaggtgactgagtggcggacgggtgagtaacgcgtggagaacctggcccatacagggggatagcggctggaaacggccggtaaaaccgcataagcgcacaagcagggcatcctgtggtgtgaaaatcgaa

SEQ ID NO: 647 - DNA, 225 bp, Unknown
  Encodes 16S rRNA from Oscillibacter
agagtttgatcatggctcaggacgaacgctggcggcgtgcctaacacatgcaagtcgaacgaagctccaacacttgagttttcggacaagagtggcggaagacttagtggcggactggtgagtaacgcgtgagcaacctgccttccggtgggggacaacagttggaaacgactgctaataccgcataacatatgtctaaggcatcttagatatatcaaagcttta

SEQ ID NO: 648 - DNA, 225 bp, Unknown
  Encodes 16S rRNA from Nitrobacter
agagtttgatcatggctcagagcgaacgctagcggaatgctttatacatgcaagtcgaacgaacgagtttatattgagtagcaatacgatttatgaatgagttagtggcaaacgggtgagtaatagttaggaacttgccgaatagtgggggacaacagatagaaatgtctgctaataccgcatattcccgagaggggaaagatttattgctatttgagaggccta

SEQ ID NO: 649 - DNA, 225 bp, Unknown
  Encodes 16S rRNA from Clostridium XlVa
agagtttgatcatggctcaggatgaacgctggcggcgtgcctaacacatgcaagtcgaacggggtacagacgctgtgagagaaagcagcttgctgtggacttaaacttgtttgtacttagtggcggacgggtgagtaacgcgtggaaaacctgcctcatacagggggataacaggaagaaattcctgctaataccgcataagcgcacggtatcgcatggtacagt

SEQ ID NO: 650 - DNA, 225 bp, Unknown
  Encodes 16S rRNA from Lachnospiracea incertae sedis
agagtttgatcctggctcaggatgaacgctggcggcgtgcttaacacatgcaagtcgaacgggacttttggagcttgctccggaagttcagtggcggacgggtgagtaacgcgtgggtaacctgccgcatgcagggggacaacagttggaaacgactgctaataccgcataagcgcacgggaccgcatggtccggtgtgaaaagatttatcggcatgcgatggac

SEQ ID NO: 651 - DNA, 225 bp, Unknown
  Encodes 16S rRNA from Limibacter
agagtttgatcatggctcaggatgaacgctagcggcaggcctaatacatgcaagtcgtacggtaagcgccccttcgggggtgtgagagtggcggacgggtgcgtaacgcgtatgcaaccaacccccctcgccgggatagccggtggaaacgccggataataccggatgcgccgcgtgggaggcatctcccgagcggcaaggcggagacgcggagggggacgggca

SEQ ID NO: 652 - DNA, 225 bp, Unknown
  Encodes 16S rRNA from Desulfovibrio
agagtttgatcctggctcagattgaacgctggcggcgtgcctaacacatgcaagtcgaacgcgaaaggggcttcggccccgagtagagtggcgcacgggtgagtaacgcgtggataatctgcccctgcggctggaatagcgactggaaacggtcgataatgccggatacgcccttgtttaacgatgaggggaaaggagacctctgcttgcaagtttccgtgcagg

SEQ ID NO: 653 - DNA, 225 bp, Unknown
  Encodes 16S rRNA from Coprococcus
agagtttgatcatggctcaggatgaacgctggcggcgtgcttaacacatgcaagtcgaacgaagcacttttctttgattcttcggatgaaaaagagatttgactgagtggcggacgggtgagtaacgcgtgggtaacctgccctgtacagggggataacagttagaaatgactgctaataccgcataagaccacagcatcgcatggtgcagtggtaaaaactccg

SEQ ID NO: 654 - DNA, 225 bp, Unknown
  Encodes 16S rRNA from Anaerovorax
agagtttgatcatggctcaggattaacgctggcggcgtgcctaacacatgcaagtcgagcgggaaatttgagagtgaggcttcggcggatctcttaaatggagagcggcggacgggtgagtaacgcgtaggtaacctgccctgcacagagggatagccactggaaacggtgattaatacctcataaaactgttttgccgcatgacagaacagccaaagatttatc

SEQ ID NO: 655 - DNA, 225 bp, Unknown
  Encodes 16S rRNA from Spirochaeta
agagtttgatcctggctcagaacgaacgctggcggcgcgtcttaagcatgcaagtcgaacggcaagctaccttcgggtagcctagagtggcggactggtgagtaacacgtgggtgacatgccttcaggactggaatagcctgcagaaatgcagggtaatgccggatacggtgcaggacgttaggggtcctgcaagaaaggagcatttgctccgccgggagattgg

SEQ ID NO: 656 - DNA, 225 bp, Unknown
  Encodes 16S rRNA from unknown taxa
agagtttgatcatggctcaggacgaacgctggcggcgtgcttcatacatgcaagtcgaacgagaagcaagagcttgctcttgtggaaagtggcggacgggtgagtaacacgtagggaatctgccttcaggcgggggacaacagttggaaacgactgctaataccccatatgagctaagttgaaatacttatcttgaaaactccggtgcctgtagatgagcctgcg

SEQ ID NO: 657 - DNA, 225 bp, Unknown
  Encodes 16S rRNA from Saccharofermentans
agagtttgatcatggctcaggacgaacgctggcggcgtgcctaacacatgcaagtcgagcggagatgaggagaagcttgcttcgagacatctcagcggcggacgggtgagtaacgcgtgagcaacctgtcctctgcagggggataagacagcgaaagttgttctaataccgcataagaccacaacgtcacatggcgaaggggtcaaaggaggaatccggcagagg

SEQ ID NO: 658 - DNA, 225 bp, Unknown
  Encodes 16S rRNA from Anaeroplasma
agagtttgatcatggctcaggattaacgctggcggcgtgcctaatacatgcaagtcggatggttagcttgctaaccatggcgaacgggtgagtaacacgtaggcaacctgtctaaaagacgaggataaccattggaaacgatggataatactggataggattatttagggcatcctagataatttaaagatttatcacttttagaggggcctgcggcgcattagc

SEQ ID NO: 659 - DNA, 225 bp, Unknown
  Encodes 16S rRNA from Clostridium III
agagtttgatcatggctcaggacgaacgctggcggcgtgcttaatccatgcaagtcgaacggggcgattccggaaagtcttcggactggaaggaagagcttagtggcgaacgggtgagtaacgcgtgaccaaccaaccttaagcagggggacaacagctggaaacggctgctaataccgcataagaccacggtggggcatctcacaggggtcaaaggagcaatcc

SEQ ID NO: 660 - DNA, 225 bp, Unknown
  Encodes 16S rRNA from Victivallis
agagtttgatcctggctcagaacgaacgctggcggcatggattaggcatgcaagtcgaacgaagcagcaatgcttagtggcgcaagggtgaggaacacgtgagtgacctacccgcaagtttggaacagctcctggaaacgggaattaataccggatgtgatcaacgggctgcatggtctgttgattaaagcagcaatgcgcttgcggatgggctcgcgtcccatt

SEQ ID NO: 661 - DNA, 225 bp, Unknown
  Encodes 16S rRNA from Enterorhabdus
agagtttgatcatggctcaggatgaacgctggcggcgtgcctaacacatgcaagtcgaacggttaaggcggcttcggccgcgaatagagtggcgaacgggtgagtaacacgtgaccaacctgccccgcgcaccgggacagcctcgtgaaaacgggattaataccggatactccggcggcgcgggatggggtcgcggcccattaggtagtaggcggggtgacggcc

SEQ ID NO: 662 - DNA, 225 bp, Unknown
  Encodes 16S rRNA from Clostridium IV
agagtttgatcatggctcaggatgaacgctggcggcgtgcttaacacattcaagtcgaacggattccaggggagcttgctccccgaagaattagtggcggacgggtgagtaacgcgtgagcaacctgccttttttcgggggataacacggggaaaccggtgctaataccgcataacgtgccgaagtcgcatggctttggtaccaaaggagtaatccgaggaaaga

SEQ ID NO: 663 - DNA, 225 bp, Unknown
  Encodes 16S rRNA from Erysipelothrix
agagtttgatcctggctcaggatgaacgctggcggcgtgcctaatacatgcaagtcgaacgaagtacttcggtacttagtggcgaacgggtgagtaacacataaacaatctaccctgaagactgggataacggttggaaacgaccgctaataccggataggtgatcttaaggcatcttgagatcattaaagttgggctacaacactgcaggatgagtttatgtcg

SEQ ID NO: 664 - DNA, 225 bp, Unknown
  Encodes 16S rRNA from Clostridium III
agagtttgatcatggctcaggacgaacgctggcggcgtgcctaacacatgcaagtcgaacggagtgtatctgtgaatgagagaagcttgcttcaggaattctttgatatcacttagtggcgcacgggtgagtaacgcgtgggcaatctgcctttcacagggggacaacagagggaaacttctgctaataccgcataacatcaatttaaggcatcttagaatgatc

SEQ ID NO: 665 - DNA, 225 bp, Unknown
  Encodes 16S rRNA from Clostridium sensu stricto
agagtttgatcatggctcaggacgaacgctggcggcatgcctaacacatgcaagtcgaacggaataggtttggttgtagcgatactttcggacctatttagtggcgaacgggtgagtaacacgtgagcaacctgccttctacacagggataacagccggaaacggctgctaataccggataagaccacaccgaggcatctcggaggggtcaaagcgatttagcgg

SEQ ID NO: 666 - DNA, 225 bp, Unknown
  Encodes 16S rRNA from Gelidibacter
agagtttgatcctggctcaggataaacgctagcggcaggcctaacacatgcaagtcgagcggcagcggggtgtagcaatacattgccggcgagcggcggacgggtgagtaacgcgtatgcaacctgcccaccacacggagatagccgaccgaaaggacgattaaactccgatggcacctcatcaaggcatcttcttgaggttaaatattcataggtggtggatgg

SEQ ID NO: 667 - DNA, 225 bp, Unknown
  Encodes 16S rRNA from Roseburia
agagtttgatcctggctcaggatgaacgctggcggcgtgcttaacacatgcaagtcgaacgaagctcttttgcggatttcttcggattgaagtagaagatgacttagtggcggacgggtgagtaacgcgtgggtaacctgcctctgacagggggacaacagttagaaatgactgctaacaccgcataagcgcacagtaaggcatcttacagtgtgaaaatattca

SEQ ID NO: 668 - DNA, 225 bp, Unknown
  Encodes 16S rRNA from Neisseria
agagtttgatcctggctcagattgaacgctggcggcatgctttacacatgcaagtcgaacggcagcgtggtagtgcttgcactactgacggcgagtggcgaacgggtgagtaatgcatcggaatgtaccgagtaatgggggataactaatcgaaagattagctaataccgcatacgacctgagggtgaaagcaggggatcttaggaccttgcgttattcgagcag

SEQ ID NO: 669 - DNA, 225 bp, Unknown
  Encodes 16S rRNA from Prevotella
agagtttgatcctggctcaggatgaacgctagctacaggcttaacacatgcaagtcgaggggcatcaggattctagcttgctaggattgctggcgaccggcgcacgggtgagtaacgcgtatccaacctgccgcatagtcgggcacagccctctgaaaggaggattaatgccggatgtggtcattgtgggacatcccattatgactgaagatttattgctatgcg

SEQ ID NO: 670 - DNA, 225 bp, Unknown
  Encodes 16S rRNA from unknown taxa
agagtttgatcatggctcaggacgaacgctggcggcgtgcttcatacatgcaagtcgaacgagaatctggtgcttgcaccagaggaaagtggcggacgggtgagtaaaatgtagagaatctgccctagagagggggatagcagttggaaacgactattaataccccatatgcgcgtagttgagatactattcgtgaaaactccggtgctctgggatgagtctgca

SEQ ID NO: 671 - DNA, 225 bp, Unknown
  Encodes 16S rRNA from Oscillibacter
agagtttgatcatggctcaggacgaacgctggcggcatgcctaacacatgcaagtcgaacgggactcttaacgaccgaggcttcggccaagtgaattttgagtttagtggcggacgggtgagtaacgcgtgagcaacctgcctttcagagggggacaacagttggaaacgactgctaataccgcatgacatacggagggggcatcccttttgtatcaaagattta

SEQ ID NO: 672 - DNA, 225 bp, Unknown
  Encodes 16S rRNA from unknown taxa
agagtttgatcatggctcagggttaacgctagcggtgcgcctaacacatgcaagtcgagcgggaatgtgagaaagcttgctttcaaacaagatagcggcgaacgggtgagtaatatgttggtatctgtccttaagtcaggaatagctcagggaaacttgaattaatgccggatgtgctctttggagtaaagatttatcgcttaagggggagccttcattctatca

SEQ ID NO: 673 - DNA, 225 bp, Unknown
  Encodes 16S rRNA from Prevotella
agagtttgatcatggctcaggatgaacgctagctacaggcttaacacatgcaagtcgcggggcagcatgggagttgcttgcaacttccgatggcgaccggcgcacgggtgcgtaacgcgtatccaacctacccgcaagtcagggccagcccggcgaaagtcggattaatccctgatgtggtgcgaagaggacatctgattcacattaaaggagcgatttgcttgc

SEQ ID NO: 674 - DNA, 225 bp, Unknown
  Encodes 16S rRNA from Saccharofermentans
agagtttgatcatggctcaggacgaacgctggcggcgtgcctaacacatgcaagtcgagcggggataattgacggaaggtttcggccggaaggcgattattctagcggcggacgggtgagtaacgcgtgagcaacctttccttcacagggggataaaacaccgaaaggtgtcctaataccgcatgagaccacgggagcacatgcttttgaggtcaaaggagcaat

SEQ ID NO: 675 - DNA, 225 bp, Unknown
  Encodes 16S rRNA from Erysipelotrichaceae incertae sedis
agagtttgatcctggctcaggattaacgctggcggcatgcctaatacatgcaagtcgaacgagagtagcaatactctagtggcgaacgggtgagtaacacgtaggcaatctacccattagacgaggataactattggaaacgatagctaaaactggataggatatagcgaggcatcttgtaatatttaaaggtcctgaaagggaacactaatggatgagcctgcg

SEQ ID NO: 676 - DNA, 225 bp, Unknown; identical to SEQ ID NO: 466
  Encodes 16S rRNA from Spirochaeta

SEQ ID NO: 677 - DNA, 225 bp, Unknown
  Encodes 16S rRNA from Clostridium XlVa
agagtttgatcatggctcaggatgaacgctggcggcgtgcctaacacatgcaagtcgaacgagcgagagatgaaacctggtgattctcaagcgagtggcggacgggtgagtaacgcgtgggtaacctgccttacagagggggataacagtctgaaaagactgctaataccgcataagcacacagtaccgcatggtacagggtgaaaagatttatcactgtaagat

SEQ ID NO: 678 - DNA, 225 bp, Unknown
  Encodes 16S rRNA from Clostridium XlVb
agagtttgatcatggctcaggacgaacgctggcggcgtgcttaacacatgcaagtcgtacggggtatagcaatatacctagtggcgaacgggtgagtaacacgtgagtaacctgccctatacagggggacaacagctggaaacggctgctaataccgcataagaccacggaaccgcatggttcaggggtaaaaggctacggccggtataggatgggctcgcgcac

SEQ ID NO: 679 - DNA, 225 bp, Unknown
  Encodes 16S rRNA from Clostridium XlVa
agagtttgatcatggctcaggatgaacgctggcggcgtgcctaacacatgcaagtcgagcggagataagttgaagcctagcgattcttatcttagcggcggatgggtgagtaacacgtgggtaacctgccctgtactggggaataacagctggaaacggctgttaatgccgcatatgcgcacggagccgcatgactccgggcggaaagatttatcggtacaggat

SEQ ID NO: 680 - DNA, 225 bp, Unknown
  Encodes 16S rRNA from Adlercreutzia
agagtttgatcctggctcaggatgaacgctggcggcgtgcctaacacatgcaagtcgaacggttaaaccggcttcggccggaaatacagtggcgaacgggtgagtaacacgtgaccaacctgccccgcgcaccgggatagccccccgaaagggggattaataccggatgcgccgggccggccgcatggccggcccgggaaagcccaggcggcgcgggatggggtc

SEQ ID NO: 681 - DNA, 225 bp, Unknown
  Encodes 16S rRNA from Clostridium XlVa
agagtttgatcctggctcaggatgaacgctggcggcgtgcctaacacatgcaagtcgaacggaaatggttgatgaagttttcggatggatttttccattttagtggcggacgggtgagtaacgcgtgggtaacctgccctgtaccgggggataacattcagaaatgagtgataataccgcataagcgcacagcttcgcatgaagcagtgtgaaaaactccggtgg

SEQ ID NO: 682 - DNA, 225 bp, Unknown
  Encodes 16S rRNA from Lachnospiracea incertae sedis
agagtttgatcctggctcaggatgaacgctggcggcgtgcctaacacatgcaagtcgaacgaagctcctttgcggaactcttcggagggaaggaaaggatgactgagtggcggacgggtgagtaacgcgtgggtaacctgccctgtacagggggacaacagttagaaatgactgctaataccgcataagcgtacagcatcgcatgatgcagtacgaaaaactgag

SEQ ID NO: 683 - DNA, 225 bp, Unknown
  Encodes 16S rRNA from Clostridium IV
agagtttgatcatggctcaggatgaacgctggcggcgtgcttaacacatgcaagtcgaacgaggttagagtcttcggattttaaccgagtggcggacgggtgagtaacgcgtgaacaatctgtcctgcaaagggggataacaactggaaacagttgctaataccgcataagaccacagtatcgcatggtacagaggtaaaagcagcaatgcgatgcagggtgagt

SEQ ID NO: 684 - DNA, 225 bp, Unknown
  Encodes 16S rRNA from Adlercreutzia
agagtttgatcctggctcaggatgaacgctggcggcgtgcttaacacatgcaagtcgaacggtcaaaccgccctcgggcggacataaagtggcgaacgggtgagtaacacgtgaccaacctgccccgcgcaccgggacagccccccgaaagggggattaataccggatactccggggagggcgcatgccctccccgggaaagctccggcggcgcgggatggggtc

SEQ ID NO: 685 - DNA, 225 bp, Unknown
  Encodes 16S rRNA from Prevotella
agagtttgatcatggctcaggatgaacgctagcgacaggcctaacacatgcaagtcgaggggcagcatggagtagcaatactctgatggcgaccggcgcacgggtgcgtaacaggtgtgcaatctgtcctataccggggaatagcccagcgaaagttgaattaaagctccatgtgagtgagagccgcatgactcccacttgaaacgtaagggtataggatgagca

SEQ ID NO: 686 - DNA, 225 bp, Unknown
  Encodes 16S rRNA from Syntrophococcus
agagtttgatcatggctcaggatgaacgctggcggcgtgcttaacacatgcaagtcgaacgggaacctcacgacggagacttcggttgaagatgtgagaattctagtggcggacgggtgagtaacgcgtgggtaacctgcccatgagaggaggataacagggagaaattcttgctaatactccatatgcttacggtatcgcatgatacagtgaggaaagaatttc

SEQ ID NO: 687 - DNA, 225 bp, Unknown
  Encodes 16S rRNA from Treponema
agagtttgatcatggctcagaataaacgctggcggcgtgtcttaagcatgcaagtcgaacggcaaggtaccttcgggtaccctagagtggcggactggtgagtaacacgtaggtgacgtaccttttggacggggatagcccgtagaaatacgggataataccggataaggttgcacgggttggagccgtgcaaggaaaggcgctacggcgtcgccgaaagaacgg

SEQ ID NO: 688 - DNA, 225 bp, Unknown
  Encodes 16S rRNA from Prevotella
agagtttgatcatggctcaggatgaacgctagctacaggcttaacacatgcaagtcgtggggcagcacgggaagcagcaatgcttttgggtggcgaccggcgaatgggtgagtaacgagtatccaacctgccccgtgctccgggacagccccgcgaaagcgggattaataccggatggtgcgtgtttcccgcatgggatatacgtcaaagattcatcggcacggg

SEQ ID NO: 689 - DNA, 225 bp, Unknown
  Encodes 16S rRNA from Clostridium III
agagtttgatcctggctcaggacgaacgctggcggcgtgcctaacacatgcaagtcgaacgagaaatatgacaatgatcctttcggggtgatttggattatggacagtggcggacgggcgagtaacgcgtgagtaacctgcccataagagagggatagccgatggaaacgtcgagtaatacctcatattgtaattaattcgcatggattgattatgaaagattta

SEQ ID NO: 690 - DNA, 225 bp, Unknown
  Encodes 16S rRNA from Pseudoflavonifractor
agagtttgatcatggctcaggatgaacgctggcggcgtgcttaacacatgcaagtcgaacggagcatacttgatggtaactgatggtattgcttagtggcggacgggtgagtaacgcgtgaggaacctgccttggagtggggaataacagtcagaaatgattgctaataccgcataatgtatacgggtcgcatggtctgtataccaaagatttatcgctctgaga

SEQ ID NO: 691 - DNA, 225 bp, Unknown
  Encodes 16S rRNA from Clostridium IV
agagtttgatcatggctcaggatgaacgctggcggcgtgcataacacattcaagtcgaacgaagcactttgacggaagccttcgggcggaagttgatttgacttagtggcggacgggtgagtaacgcgtgagcaacctgcctgtatgtgagggataacacagggaaacttgtgctaataccgcatgaagcatgggaatcgcatggttttgatgccaaagacttgt

SEQ ID NO: 692 - DNA, 225 bp, Unknown
  Encodes 16S rRNA from Sharpea
agagtttgatcatggctcaggattaacgctggcggcgtgcctaatacatgcaagtcggccggggaggggaaagcttgctttcacctcccaggggcgaacgggtgagtaatacgtaagcaacctgcccgcgggtccgggataagccctggaaacggggtctaagaccggataggcggcgggggcgcatgccccctccgttaaaggcgagaaacgcctgcggatggg

SEQ ID NO: 693 - DNA, 225 bp, Unknown
  Encodes 16S rRNA from Dongia
agagtttgatcatggctcagaacgaacgctggcggcacgcttaacacatgcaagtcgaacggtgcaatggggcttgctctattgcatagtggcggacgggtgagtaacacgtaggaacctacctggtaatggtggatagcttcgggaaactggaggtaatacagcatgagctcgagagaggaaaggccataaggtcgttaccagaggggcctgcggatgattagg

SEQ ID NO: 694 - DNA, 225 bp, Unknown
  Encodes 16S rRNA from Eubacterium
agagtttgatcatggctcaggacgaacgctggcggcgtgcctaacacatgcaagtcgaacgaagcttgaattcagaattcttcggaaggacgaatgaaatgactgagtggcggacgggtgagtaacgcgtgagcaacctgccctttggatggggatagcgtttggaaacgaacggtaatacccaataaagtatatttgtggcatcgcagatataccaaagctccg

SEQ ID NO: 695 - DNA, 225 bp, Unknown
  Encodes 16S rRNA from Prevotella
agagtttgatcatggctcaggatgaacgctagctacaggcttaacacatgcaagtcgaggggcagcatgtcgtgtgcttgcacacgatgatggcgaccggcgcacgggtgagtaacgcgtatccaacctgcccatgaccccgggatagcccgctgaaaagcggattaacaccggatgtggtcgaacgaggacatctgatttcgaccaaagcttttttgcggtcat

SEQ ID NO: 696 - DNA, 225 bp, Unknown
  Encodes 16S rRNA from Clostridium IV
agagtttgatcatggctcaggacgaacgctggcggcgtgcttaacacatgcaagtcgaacgagaacctgtggaaggagttttcggacaacggaaacaggggaaagtggcggacgggtgagtaacgcgtgaggaacctgccttggagagggggacaacagctggaaacggctgctaataccgcatgatgcacgatggggacatccccgacgtgccaaagatttatc

SEQ ID NO: 697 - DNA, 204 bp, Unknown
  Encodes 16S rRNA from Parabacteroides
agagtttgatcatggctcaggatgaacgctagcgacaggctttggtcaatggacgctagtctgaaccagccaagtcgcgtgcgggatgaaggccctccgggtcgtaaaccgctttagccggggagtaacgtgggggacgcgtccctcagtgagagtacccggagaataagcatcggctaactccgtgccagcagccgcggtaat

SEQ ID NO: 698 - DNA, 225 bp, Unknown; identical to SEQ ID NO: 518
  Encodes 16S rRNA from Brevundimonas

SEQ ID NO: 699 - DNA, 225 bp, Unknown
  Encodes 16S rRNA from Clostridium XlVa
agagtttgatcctggctcaggatgaacgctggcggcgtgcttaacacatgcaagtcgaacggactttactgaaaagagggcttgcccgatggaaggtaaagttagtggcggacgggtgagtaacgcgtgggtaacctgccttacacagggggacaacagttggaaacgactgctaataccgcataagccggtagtgccgcatggcacatccggaaaagatttatc

SEQ ID NO: 700 - DNA, 225 bp, Unknown
  Encodes 16S rRNA from Ruminococcus
agagtttgatcctggctcaggacgaacgctggcggcacgcttaacacatgcaagtcgaacggaacttgggagcttgctttcaagtttagtggcggacgggtgagtaacacgtgagcaacctgcctttcggcggggaataatgattggaaacgatcactaataccccataaaataaatttaccgcatgataaatttatcaaagattcatcaccgaaagatgggctc

SEQ ID NO: 701 - DNA, 225 bp, Unknown
  Encodes 16S rRNA from Thermotalea
agagtttgatcctggctcaggattaacgctggcggcgtgcctaacacatgcaagtcgagcgagaattgacagaatgaaacttcggtggaattcagtcaaggacagcggcggacgggtgagtaacgcgtgggcaacctgcccctttccggaggatagccaagggaaactttgaataatactccataaagcatcattaccgcatgatagagatgccaaagatttatc

SEQ ID NO: 702 - DNA, 225 bp, Unknown
  Encodes 16S rRNA from Victivallis
agagtttgatcctggctcagaacgaacgctggcggcatggattaggcatgcaagtcgaacggtgcagcaatgcatagtggcgcaagggtgaggaacgcgtgagtaatctgccctcaagttgggaacagcttctggaaacggaaattaataccgaatgtgatctcagggaggcatctttctgggattaaaggccgcaaggtcgcttgaggaggggctcgcgtccca

SEQ ID NO: 703 - DNA, 225 bp, Unknown
  Encodes 16S rRNA from Anaeroplasma
agagtttgatcatggctcaggattaacgctggcggcgtgcctaatacatgcaagtcgaatggttagcttgctaaccatggcgaacgggtgagtaacacgtaggcaacctgtctatcagccgaggataaccattggaaacgatggataatactggataggatatagataggcatctaattatatttaaagatttatcactgatagaggggcctgcggcgcattagc

SEQ ID NO: 704 - DNA, 225 bp, Unknown
  Encodes 16S rRNA from Oscillibacter
agagtttgatcctggctcaggacgaacgctggcggcgtgcctaacacatgcaagtcgaacgaagctccgagaaacaagacttcggtcaagcggaacggatgactgagtggcgaacgggtgagtaacgcgtgaggaacctgcctttcagtgggggataacagttggaaacgactgctaataccgcatgaagtattctgggggcatccccggggtaccaaagattta

SEQ ID NO: 705 - DNA, 225 bp, Unknown
  Encodes 16S rRNA from Ruminococcus
agagtttgatcctggctcaggacgaacgctggcggcacgcctaacacatgcaagtcgagcggtgaattttggatttattcgagattcatagcggcggacgggtgagtaacacgtgagcaacctacctctaagtgagggatagcttctggaaacggatggtaataccttataatatatatttatcacatgatagatatatcaaagatttattgcttagagatgggc

SEQ ID NO: 706 - DNA, 225 bp, Unknown
  Encodes 16S rRNA from Clostridium XlVa
agagtttgatcctggctcaggatgaacgctggcggcgtgcctaacacatgcaagtcgaacgaggctctgcgaaatgaagattcgtctgaatttcaaggatgtccgagtggcggatgggtgagtaacgcgtggagaacctgccctatgctgggggataacaactggaaacggttgacaataccgcataagcttccttagtcgcatgaccttggaaggaaagattta

SEQ ID NO: 707 - DNA, 225 bp, Unknown
  Encodes 16S rRNA from Clostridium XlVa
agagtttgatcctggctcaggatgaacgctggcggcgtgcttaacacatgcaagtcgaacgaatttccttcgaacagaggcttcggccaacgggagattgaagtgagtggcggacgggtgagtaacgcgtgggtaacctgccttacaccgggggataacagagggaaacttctgctaataccgcataagaccacggtaccgcatggtacagaggtaaaagttccg

SEQ ID NO: 708 - DNA, 225 bp, Unknown
  Encodes 16S rRNA from Clostridium IV
agagtttgatcatggctcaggatgaacgctggcggcgtgcttaacacattcaagtcgaacgaagcatattggaacgagacttcggtcaagggaaggtatgacttagtggcggacgggtgagtaacgcgtgagcaacctgcctcggggtgcgggataacgattggaaacgaccgctaataccgcatgacgcatatttttcgcatgtgagatatgccaaagattcat

SEQ ID NO: 709 - DNA, 225 bp, Unknown
  Encodes 16S rRNA from Roseburia
agagtttgatcatggctcaggatgaacgctggcggcgtgcttaacacatgcaagtcgaacggagatgtttcgctggggcggcttcggccaaaccttgaggcatcttagtggcggacgggtgagtaacgcgtgggtaacctgcctatcacagggggacaacagttggaaacgactgctaataccgcataagcgcacggcaccgcatggtgcagtgtgaaaagattc

SEQ ID NO: 710 - DNA, 225 bp, Unknown
  Encodes 16S rRNA from Eggerthella
agagtttgatcctggctcaggatgaacgctggcggcgtgcctaacacatgcaagtcgaacggagaaaccgccctcgggcggagatgaagtggcgaacgggtgagtaacacgtgaccaacctgccccgcgcaccgggacagccccccgaaagggggattaataccggatgcgccggccgggccgcatggcccggccgggaaagcccaggcggcgcgggatggggtc

SEQ ID NO: 711 - DNA, 225 bp, Unknown
  Encodes 16S rRNA from Clostridium III
agagtttgatcatggctcaggacgaacgctggcggcgtgcctaacacatgcaagtcgaacggacatactagcaatagtatgttagtggcggacgggtgagtaatacatgagtaacctgccttatacagggggataacacttagaaataggtgctaataccgcataataacccttggtggcatcaccaggggaggaaaggagaaatccagtaaaagatgggctcat

SEQ ID NO: 712 - DNA, 225 bp, Unknown
  Encodes 16S rRNA from Clostridium XlVa
agagtttgatcctggctcaggatgaacgctggcggcgtgcctaacacatgcaagtcgaacggggtacagacgctgtgagaagaagtgcttgcacggaatcgaacttgtttgtacttagtggcggacgggtgagtaacgcgtggaaaacctgcctcatacagggggataacaggaagaaattcctgctaataccgcataagcgcacagtatcgcatgatagagtgt

SEQ ID NO: 713 - DNA, 225 bp, Unknown
  Encodes 16S rRNA from Lactobacillus
agagtttgatcatggctcaggacgaacgctggcggcgtgcctaatacatgcaagtcgaacgcatcccgttgaattgaagtgcttgcactgatttttaacatcggatgagtggcgaactggtgagtaacacgtgggtaacctgcccagaagcgggggataacacttggaaacaggtgctaataccgcataacaacagaaaccgcatggtttctgtttgaaagatgg

SEQ ID NO: 714 - DNA, 225 bp, Unknown
  Encodes 16S rRNA from Bacteroides
agagtttgatcctggctcaggatgaacgctagctacaggcttaacacatgcaagtcgaggggcagcatgacgatagcttgctattgttgatggcgaccggcgcacgggtgcgtaacacgtatccaatctacccggtactcggggatagcctttcgaaagaaagattaatacccgatactgttggatctccgcatggcggtccaaccaaagatttcatcggtgccg

SEQ ID NO: 715 - DNA, 225 bp, Unknown
  Encodes 16S rRNA from Cellulosilyticum
agagtttgatcatggctcaggatgaacgctggcggcgtgcctaacacatgcaagtcgagcggagataatgcaccggatgaagattcgtcggattccaccgcgttatcttagcggcggatgggtgagtaacacgtggacaacctgcccataactgggggatagcagttggaaacgactgataataccgcatatgctcacagcaccgcatggtgcagggaggaaaga

SEQ ID NO: 716 - DNA, 225 bp, Unknown
  Encodes 16S rRNA from Brevundimonas
agagtttgatcatggctcaggacgaacgctggcggtgtgcctcatacatgcaagtcgaacgataaggtctcttcggagatacataagtggcggacgggtgagtacaacataggaaatctgccttagggtgggggacaacagagggaaactcctgctaataccccatatgagctaacttgaaatagttatcttgaaaactccggtgccctaagatgagcctgtgcc

SEQ ID NO: 717 - DNA, 225 bp, Unknown
  Encodes 16S rRNA from Clostridium IV
agagtttgatcatggctcaggatgaacgctggcggcgtgcataacacattcaagtcgaacgaagcactgacgatgaagtcttcggacggaattgtctttgacttagtggcggacgggtgagtaacgcgtgagcaaccttcctgtttgtgagggataacacagggaaacttgtgctaataccgcatgacgcatgggaatcgcatggtttcgatgccaaagatttat

SEQ ID NO: 718 - DNA, 225 bp, Unknown
  Encodes 16S rRNA from Prevotella
agagtttgatcctggctcaggatgaacgctagctacaggcttaacacatgcaagtcgaggggcagcatgacgagtgcttgcacttgttgatggcgaccggcgcacgggtgcgtaacgcgtatcgaaccttccccttactcgggaatagcccggtgaaaaccgaattaatgcccgatatatatttagatggcatcagaagagtatgaaagatttatcggtaaggga

SEQ ID NO: 719 - DNA, 225 bp, Unknown
  Encodes 16S rRNA from Helicobacter
agagtttgatcatggctcagagttaacgctggcggcgtgcctaacacatgcaagtcgagcgagtgcttgtaaagactagcggcaaacgggtgagtaacacatgggaaaccttccttagaatgggggatatctccgtgaaaacggagctaataccgcataagaccacagtttggcatcgaacaggggtaaaagcagcaatgtgttctaagatggtcctgtgtccta

SEQ ID NO: 720 - DNA, 225 bp, Unknown
  Encodes 16S rRNA from Clostridium IV
agagtttgatcctggctcaggacgaacgctggcggcacgcttaacacatgcaagtcgaacggagttgtattagcttgctaatataacttagtggcggacgggtgagtaacacgtgagcaacctgccttcgagagtggaataatgtttggaaacggacactaataccgcatgacatacggaattcgcatgtttttcgtatcaaagatttatcgctcgaagatgggc

SEQ ID NO: 721 - DNA, 225 bp, Unknown
  Encodes 16S rRNA from Proteiniclasticum
agagtttgatcatggctcaggacgaacgctggcggtatgcctaacacatgcaagtcgaacgaaaacggggcttgctctcgtttttagtggcgcacgggtgagtaacgcgtgagtaatctgccttaaagtggggaacaacatttggaaacgaatgctaataccgcgtaatatacagttttcgcatgaattttgtattatagatttatcgctttaagatgagctcgc

SEQ ID NO: 722 - DNA, 225 bp, Unknown
  Encodes 16S rRNA from Brevundimonas
agagtttgatcatggctcagagcgaacgctggcggcaggcctaacacatgcaagtcgaacgaactcttcggagttagtggcggacgggtgagtaacacgtgggaacgtgcctttaggttcggaataactcagggaaacttgtgctaataccgaatgtgcccttcgggggaaagatttatcgcctttagagcggcccgcgtctgattagctagttggtgaggtaaa

SEQ ID NO: 723 - DNA, 225 bp, Unknown
  Encodes 16S rRNA from Clostridium XlVa
agagtttgatcatggctcaggatgaacgctggcggcgcgcataacacatgcaagtcgaacggagtcacattgaaacctagtgatttgtgacttagtggcggacgggtgagtaacgcgtgggtaacctgcctggtattgggggacaacagttagaaatgactgctaataccgcatacgacatccggagggcatcctctggatgggaaaggatttatccgatatcag

SEQ ID NO: 724 - DNA, 204 bp, Unknown
  Encodes 16S rRNA from Prevotella
agagtttgatcctggctcaggatgaacgctagctacaggctttggtcaatgggcggaagcctgaaccagccaagtagcgtgcaggatgacggccctatgggttgtaaactgcttttatgcgggaataaagaggctcacgtgtgggctgttgcatgtaccgcatgaataaggaccggctaattccgtgccagcagccgcggtaat

SEQ ID NO: 725 - DNA, 225 bp, Unknown
  Encodes 16S rRNA from Desulfovibrio
agagtttgatcatggctcagattgaacgctggcggcgtgcttaacacatgcaagtcgaacgcgaaaggggcttcggccccgagtagagtggcgcacgggtgagtaacgcgtggataatctgcccctgcaactggaatagcgactggaaacggtcgataataccggatacgcccttgttgaactatgaggggaaaggagacctctgcttgcaagtttccgtgcagg

SEQ ID NO: 726 - DNA, 225 bp, Unknown
  Encodes 16S rRNA from Coraliomargarita
agagtttgatcatggctcagagtgaacgctggcggcgtggctaagacatgcaagtcgggcggttgtgcgccttcgggtgtacaatagcggcaaacgggtgagtaacacgtaagtaacctgcccttaagactgggatagcccagcgaaagttggggtaataccggatgaggacctttagcgcatgttaagggatcgaaaggtatgagaagacgcttaaggaggggc

SEQ ID NO: 727 - DNA, 225 bp, Unknown
  Encodes 16S rRNA from Eubacterium
agagtttgatcatggctcaggatgaacgctggcggcgtgcttaacacatgcaagtcgagcgagaaatgactgacggattcttcggatgacggaggtcatggacagcggcggacgggtgagtaacgcgtgggcaacctgcccttaactgagggatagccgagggaaacttcgtgtaatacctcataacgcattttgaccgcatgatcgaaatgccaaagatttatc

SEQ ID NO: 728 - DNA, 225 bp, Unknown
  Encodes 16S rRNA from Sphingomonas
agagtttgatcatggctcagagcgaacgctagcggcatgcttaacacatgcaagtcgaacgagggaagttgattgagtagcaatacgatttcaatggaacgagtggcaaacgggtgagtaatatattggaacttgcccagtagtgggggacaacagttggaaacgactgctaataccgcataacgcagagatgcgaaagccgaaaggcgctattggagaggccaa

SEQ ID NO: 729 - DNA, 225 bp, Unknown
  Encodes 16S rRNA from Prevotella
agagtttgatcctggctcaggatgaacgctagctacaggcttaacacatgcaagtcgaggggtaacatgaagaaagcttgctttctttgatgacgaccggcgcacgggtgagtatcgcgtatccaacctgcccataagtagggaatagccttgcgaaagtaagattaatgccctatggtttccgtcgtagacatcttagatggaataaagatttatcgcttatgg

SEQ ID NO: 730 - DNA, 225 bp, Unknown
  Encodes 16S rRNA from Clostridium IV
agagtttgatcctggctcaggacgaacgctggcggtatgcctaacacatgcaagtcgaacgggtgttgaagagcttgctcttcttctactagtggcggacgggtgagtaacgcgtgagtaatctgcctcaaagtgggggataacacttagaaatgagtgctaataccgcgtaatgtgctaacttcgcatgaagtctgcaccatggtttttcgctttgagatgagc

SEQ ID NO: 731 - DNA, 225 bp, Unknown
  Encodes 16S rRNA from Paraprevotella
agagtttgatcatggctcaggatgaacgctagcggcaggcttaacacatgcaagtcgaggggcagcgagtcggtagcaatactgatgtcggcgaccggcgcacgggtgagtaacgcgtatgcaacctttcccagacagggggatagcccagggaaacttggattaataccccgtaggccgagggatggcatcgtccttcggttaaagttccggcggtctggggtg

SEQ ID NO: 732 - DNA, 225 bp, Unknown
  Encodes 16S rRNA from Ruminococcus
agagtttgatcctggctcaggacgaacgctggcggcacgcttaacacatgcaagtcgaacggagttaaaggagcttgctcctttaacttagtggcggacgggtgagtaacacgtgagcaacctgccttacagagaggaataatgattggaaacggtcactaatacctcataaaatatctatactgcatggtataggatatcaaagatttatcgctgtaagatggg

SEQ ID NO: 733 - DNA, 225 bp, Unknown
  Encodes 16S rRNA from Saccharofermentans
agagtttgatcatggctcaggatgaacgctggcggcgcatttaagacatgcaagtcgaacgaagaatttgcaccgaatgaaagatgaagattcatcagattctggatttcaccgtaaattcttagtggcggacgggtgagtaatacgtagataatctgccttctagagggaaataacagagagaaatttctgctaatgtcccataagaccacactatggcatctt

SEQ ID NO: 734 - DNA, 225 bp, Unknown
  Encodes 16S rRNA from Clostridium III
agagtttgatcctggctcaggacgaacgctggcggcgtgcctaacacatgcaagtcgagcggagccatccgaaagatcccttcggggtgattttggtgaagcttagcggcggacgggtgagtaacgcgtgagtaacctgcccattagtggggaataacacagagaaatttgtgctaataccgcataccgatgcgggagggcatcctcctgtattgaaagatttat

SEQ ID NO: 735 - DNA, 225 bp, Unknown
  Encodes 16S rRNA from Clostridium III
agagtttgatcatggctcaggacgaacgctggcggcgtgcctaacacatgcaagtcgaacgaacgaggtagcaatactgagttagtggcggacgggtgagtaatgcatgagcaacctacctcatacagggggatagcacttagaaatgagtggtaataccgcataataaccatacatggcatcatgtaaggaggaaaggaggaatccggtaagagatgggctcat

SEQ ID NO: 736 - DNA, 225 bp, Unknown
  Encodes 16S rRNA from Turicibacter
agagtttgatcatggctcaggatgaacgctggcggcgtgcctaatacatgcaagtcgaacgagagtacttgtactcgagtggcgaacgggtgagtaacacgtaggtaacctgcctttcagtttgggatacccagaggaaactttggctaataccggataactggtctggaggcatctccggatcctaaaaggggctccaaagcctcgctgattgatggacctgcg

SEQ ID NO: 737 - DNA, 225 bp, Unknown
  Encodes 16S rRNA from Prevotella
agagtttgatcatggctcaggatgaacgctagctacaggcttaacacatgcaagtcgaggggcagcatgtatctggcttgccagatatgatggcgaccggcgcacgggtgcgtaacgcgtatccaacctgccgtttacccggggacagcctcgcgaaagcgagattaatacccgatgttgtgcgtattccgcatggtgtgcgcaccaaaggtttttccggtaagc

SEQ ID NO: 738 - DNA, 225 bp, Unknown
  Encodes 16S rRNA from Clostridium XlVa
agagtttgatcctggctcaggatgaacgctggcggcgtgcctaacacatgcaagtcgagcggggatgcgccaaagatgatgactcgtctgattcttagcgcatcttagcggcggatgggtgagtaacgcgtggacaacctgcccgcaacagggggataacagctggaaacggctgataataccgcatatgcacacgtggccgcatggccatgggtggaaagattt

SEQ ID NO: 739 - DNA, 225 bp, Unknown
  Encodes 16S rRNA from Fusibacter
agagtttgatcctggctcaggatgaacgctggcggcgtgcctaacacatgcaagtcgagcgagaaatcgctcaatgatctttcgggtgatttgagcgatggaaagcggcggacgggtgagtaacgcgtaggtaacctgccccatacagagggatagccactggaaacggtgattaatacctcataacaccggaatatcgcatggtataccggtcaaagtttttcg

SEQ ID NO: 740 - DNA, 225 bp, Unknown
  Encodes 16S rRNA from Clostridium XlVa
agagtttgatcctggctcaggatgaacgctggcggcgtgcctaacacatgcaagtcgaacgaagctctcttttggaacccttcggggtgaagaaggagatgactgagtggcggacgggtgagtaacgcgtgggtaacctgccctgtacagggggacaacagttagaaatgactgctaataccgcataagcgcacagcaccgcatggtgccgtgtgaaaagccttt

SEQ ID NO: 741 - DNA, 225 bp, Unknown
  Encodes 16S rRNA from Clostridium IV
agagtttgatcatggctcaggacgaacgctggcggcacgcttaacacatgcaagtcgaacggagttaatgaagcttgctttattaacttagtggcggacgggtgagtaacacgtgagcaacctgccttacagagaggaataatgattggaaacgatcactaatacctcataacatatttgaatcgcatggtttggatatcaaagatttatcgctgtaagatgggc

SEQ ID NO: 742 - DNA, 225 bp, Unknown
  Encodes 16S rRNA from Rummeliibacillus
agagtttgatcatggctcaggacgaacgctggcggcgtgcctaatacatgcaagtcgagcgaatgacgaggagcttgctcctctgatttagcggcggacgggtgagtaacacgtgggtaacctgccctgtagactgggataacttcgggaaaccggagctaataccggataattcttttaacctcatggttttaagctgaaaggcgcttcggcgtcactacagga

SEQ ID NO: 743 - DNA, 225 bp, Unknown
  Encodes 16S rRNA from Mogibacterium
agagtttgatcctggctcaggatgaacgctggcggcgtgcctaatacatgcaagtcgagcgagaatcaatagatcagcgatttatcaaagagacattgaggaaagcggcggacgggtgagtaacgcgtaggcaacctgcccctggcagagggatagccattggaaacgatgattaaaacctcataacgccggaagcacacatgtgctatcggccaaagatttatc

SEQ ID NO: 744 - DNA, 225 bp, Unknown
  Encodes 16S rRNA from Bacteroides
agagtttgatcatggctcaggatgaacgctagcgacaggcctaacacatgcaagtcgagggagaagttggaggtagcttgctactgaagatggaaaccggcgcacgggtgcgtaacaggtatgcaatctgtcctataccggaggatagcccactgaaaggtggattaatactccatgtgccactgcggggcatcctatggtggtgaaacttgagggtatagggtg

SEQ ID NO: 745 - DNA, 225 bp, Unknown
  Encodes 16S rRNA from Pelospora
agagtttgatcatggctcaggatgaacgctggcggcgcgcttaacacatgcaagtcgaacggaatgattgacttcggtcatgaattcagtggcggacgggtgagtaacacgtggataacttgccttttagtgggggatagctgagagaaatctcaattaataccgcataacgtgatttattcgcatggatagattaataaaggtgaaaatcgctaaaagataggt

SEQ ID NO: 746 - DNA, 225 bp, Unknown
  Encodes 16S rRNA from Eggerthella
agagtttgatcatggctcaggatgaacgctggcggcgtgcttaacacatgcaagtcgaacgattaaaccacttcggtggatatagagtggcgaacgggtgagtaacacgtgggcaacctgcccctcacaccgggacaactattggaaacgatagctaataccggatactccgatcgcgtggcatcacgctttcgggaaagcccagacggtgagggatgggcccgc

SEQ ID NO: 747 - DNA, 225 bp, Unknown
  Encodes 16S rRNA from Eubacterium
agagtttgatcctggctcaggatgaacgctggcggcgtgcttaacacatgcaagtcgaacggaacttatcttctgaagttttcggatggacgaaggtaagtttagtggcggacgggtgagtaacgcgtgggtaacctgccctgtacagggggataacagttagaaatgactgttaataccgcataagaccacagcaccgcatggtgcaggggtaaaagctgcgac

SEQ ID NO: 748 - DNA, 225 bp, Unknown
  Encodes 16S rRNA from Blautia
agagtttgatcatggctcaggatgaacgctggcggcgtgcctaacacatgcaagtcgaacggagcttacttttttaatacttcggtaagcgagaagtaagcttagtggcggacgggtgagtaacgcgtggagaacctgccctgtactgggggataacagtgagaaatcactgctaataccgcataagcgcacggagccgcatggcccagtgtgaaaaactccggt

SEQ ID NO: 749 - DNA, 225 bp, Unknown
  Encodes 16S rRNA from Clostridium XlVb
agagtttgatcatggctcaggatgaacgctggcggcgtgcctaacacatgcaagtcgagcgaagttttaggaaagcttgctttccgaagaacttagcggcggacgggtgagtaacgtgtgggtaacttgccctatgcagagggataacagtgagaaatcactgctaatacctcataagctcacactttcacatgggagagtgagaaaagatttatcggcatagga

SEQ ID NO: 750 - DNA, 225 bp, Unknown
  Encodes 16S rRNA from Ehrlichia
agagtttgatcatggctcagaacgaacgctggcggtatgctttaaccatgcaagtcgaacgagaaagggtagcaatacctgagtaaagtggcaaacgggtgagtaacacacaggaatctacccagtagaggggaataagcactggaaacggtgtctaatactccatacgccggtatagcaatatatcgggaaagggctagtagcaatattagttcactattggat

SEQ ID NO: 751 - DNA, 225 bp, Unknown
  Encodes 16S rRNA from Eubacterium
agagtttgatcctggctcaggatgaacgctggcggcgtgcttaacacatgcaagtcgagcgagaatcgaggaaacgatacttcggtaaagcggaatcgaggacagcggcggacgggtgagtaacgcgtgggcaacctgccccttactggtggatagccgcgggaaactgcgagtaatacaccataatgcatcgatgagacatctcaatgatgccaaagatttatc

SEQ ID NO: 752 - DNA, 154 bp, Unknown
  Encodes 16S rRNA from Prevotella
agagtttgatcatggctcagattgaacgctggcggcaggcttaacacatgcaagtcgtacggtaacagaggggaataaagtgaggtacgtgtacctttttgtatgtaccctatgaataaggaccggctaattccgtgccagcagccgcggtaat

SEQ ID NO: 753 - DNA, 225 bp, Unknown
  Encodes 16S rRNA from Clostridium XlVa
agagtttgatcatggctcaggatgaacgctggcggcgtgcctaacacatgcaagtcgagcggagtttaggggaaggcggattcgtccaacggaacctaaacttagcggcggatgggtgaggaacgcgtggataacctaccgtgcacagggggataacagttggaaacgactgttaataccgcatatgctcacagtaccgcatggtacagggaggaaagatttatc

SEQ ID NO: 754 - DNA, 225 bp, Unknown
  Encodes 16S rRNA from Treponema
agagtttgatcatggctcagaacgaacgctggcggcgcgtcttaagcatgcaagtcgaacggcaagatggtagcttgctactatcctagagtggcggactggtgagtaacacgtgggtgacgtacccttcagacggggatagctggtagaaatatcagataataccggatacgattctgtaagttagaggtacagaaggaaaggagctatggcttcgctgaagga

SEQ ID NO: 755 - DNA, 225 bp, Unknown
  Encodes 16S rRNA from Hydrogenoanaerobacterium
agagtttgatcatggctcaggataaacgctggcggcgcacataagacatgcaagtcgaacgggaactttattgaagttatctgatataaagttctagtggcggactggtgagtaatgtataagcaacctgcctataagaggggaataacagtgagaaatcattgctaataccgcataagctgtgagaatggcatcattcaaacagaaaaggaagcaattccgctt

SEQ ID NO: 756 - DNA, 225 bp, Unknown
  Encodes 16S rRNA from Selenomonas
agagtttgatcatggctcaggacgaacgctggcggcgtgcttaacacatgcaagtcgaacggggcgattgaaagcttgcttttatgagcctagtggcaaacgggtgagtaacgcgtgggcaacctgccggaaagatggggacaacatcccgaaaggggtgctaataccgaatgttgtatataaggcgcatgccttgtatattaaaggatctaatccgctttccga

SEQ ID NO: 757 - DNA, 225 bp, Unknown
  Encodes 16S rRNA from Saccharofermentans
agagtttgatcatggctcaggatgaacgctggcggcgtgcataacacattcaagtcgaacggactcaggggcttcggccccgaaagtcagtggcggacgggtgagtaacgcgtgagcaacctgcctccggaagagggataacagttggaaacgactgctaataccgcataacactgcgagtacgcatgtacatgcagtcaaaggagcaatccgaccggagatggg

SEQ ID NO: 758 - DNA, 225 bp, Unknown
  Encodes 16S rRNA from Clostridium IV
agagtttgatcctggctcaggattaacgctggcggcgtgcataacacattcaagtcgaacggacggaagagcttcggttcttacgtcagtggcggacgggtgagtaacgcgtgagcaatctgccctttacagcgggataacacagagaaatttgtgctaatacggcataacatatcggagtcgcatggcattggtatcaaagatttatcggtaaaggatgagctc

SEQ ID NO: 759 - DNA, 225 bp, Unknown
  Encodes 16S rRNA from Clostridium sensu stricto
agagtttgatcatggctcaggacgaacgctggcggcgtgcctaacacatgcaagtcgagcggggactgcgcgacggacctgaagatttcggttggatgggaagatgcacagttctagcggcggacgggtgagtaacgcgtgagcaacctgtcccttacagggggataacacagcgaaagttgtactaataccgcataagaccacggcatcacatggtggtggggt

SEQ ID NO: 760 - DNA, 225 bp, Unknown
  Encodes 16S rRNA from Anaerovorax
agagtttgatcatggctcaggatgaacgctggcggcgtgcctaacacatgcaagtcgagcgggagtataccaaacagagattcgtcgaagtaaggtatatgagagcggcggacgggtgagtaacgcgtaggtaacctaccttaagctgagggataacccagggaaacttgggataataccacataacgcggtgaagtcacatggctttaccgccaaagatttatc

SEQ ID NO: 761 - DNA, 225 bp, Unknown
  Encodes 16S rRNA from Spirochaeta
agagtttgatcatggctcagaacgaacgctggcggcgcgttttaagcatgcaagtcgagcggtaagccggagcaatccggcctagagcggcggacgggtgagtaacacgtggataatctggcctacagtttgggatagcctggtgaaagccaggataataccggatacgacagttttaacagaagttaagattgggaaaggggctaaggcctcgctgaaggatga

SEQ ID NO: 762 - DNA, 225 bp, Unknown
  Encodes 16S rRNA from Brevundimonas
agagtttgatcatggctcaggacgaacgctggcggcgtgcttcatacatgcaagtcgaacgagaatctctagcttgctagagaggaaagtggcggacgggtgagtaatatgtagagaatctgccctagagagggggacaacagagggaaactcctgctaataccccatatgagcgtacctgtgatggtattcttgaaaactccggtgctctaggatgagtctgca

SEQ ID NO: 763 - DNA, 225 bp, Unknown
  Encodes 16S rRNA from Eubacterium
agagtttgatcctggctcaggatgaacgctggcggcgtgcctaacacatgcaagtcgagcgagaaacttttgtgatgaagcttcggtagattctttaaagtggaaagcggcggacgggtgagtaacgcgtaggcaacctgcccttagcagggggatagccattggaaacgatgattaaaaccccataatgcagagagttcacatgtattttctgccaaagattta

SEQ ID NO: 764 - DNA, 225 bp, Unknown
  Encodes 16S rRNA from Clostridium XlVa
agagtttgatcatggctcaggatgaacgctggcggcgtgcctaacacatgcaagtcgaacggagttgtttctatccgacagatcatcttcggatgtgaagtcaccagaaacgcttagtggcggacgggtgagtaacgcgtgggcaacctgccctgcacagggggatagcggttggaaacgaccggtaataccgcataccttgtatttaacgcatgttagatataa

SEQ ID NO: 765 - DNA, 225 bp, Unknown
  Encodes 16S rRNA from Anaerovorax
agagtttgatcctggctcaggatgaacgctggcggcgtgcctaacacatgcaagtcgagcgagaatcttagaagtgaagtttcgatggatcttttaagaggagagcggcggacgggtgagtaacgcgtaggcaacctgcctcacactgagggatacttccgggaaactggaactaatacctcataacgcgagagtttcacatgttactctcgccaaagatttatc

SEQ ID NO: 766 - DNA, 225 bp, Unknown
  Encodes 16S rRNA from Ruminococcus
agagtttgatcctggctcaggacgaacgctggcggcacgcttaacacatgcaagtcgaacggagtattttggagcttgctctgagatgcttagtggcggacgggtgagtaacacgtgagcaacctgccttcaagtgcggaatagcttctggaaacggatggtaataccgcataatgttatctggccgcatgaccggataaccaaagaaattcgcttgaagatggg

SEQ ID NO: 767 - DNA, 225 bp, Unknown
  Encodes 16S rRNA from Papillibacter
agagtttgatcatggctcaggacgaacgctggcggcgtgcttaacacatgcaagtcgaacggagttatttccgacacggagccacttgagagagtggttgcgtgttggggataacttagtggcgaacgggtgagtaacgcgtaagcaatctgccttacagagggggataacgtttggaaacgaacgctaataccgcataacgtcatgaagaggcatctttttatg

SEQ ID NO: 768 - DNA, 225 bp, Unknown
  Encodes 16S rRNA from Clostridium IV
agagtttgatcatggctcaggatgaacgctggcggcgcgcctaacacatgcaagtcgaacggagttatcttattagatcccttcggggtgacgattttttaacttagtggcgaacgggtgagtaacgcgtgagtaacctgccttcaagagggggacaacagttggaaacgactgctaataccgcataacataacgaagccgcatgactttgttatcaaaggagca

SEQ ID NO: 769 - DNA, 225 bp, Unknown
  Encodes 16S rRNA from Hydrogenoanaerobacterium
agagtttgatcatggctcaggatgaacgctggcggcgtgcctaacacatgcaagtcgaacggaactttttacggacaagacttcggtcaagtctgtttcaagtttagtggcggacgggtgagtaacgcgtgagcaacctgcctttcagagggggataacgttcggaaacgatcgctaataccgcataacatagggatatcgcatggtaaccctatcaaagatttt

SEQ ID NO: 770 - DNA, 225 bp, Unknown
  Encodes 16S rRNA from Asaccharobacter
agagtttgatcatggctcaggatgaacgctggcggcgtgcttaacacatgcaagtcgaacgagaaagcaccttcgggtgtgagtagagtggcgaacgggtgagtaacacgtgagcaacctgcctttcacatcgggataacctatggaaacgtaagctaataccgaatactccatttccttcgcatgttggatctgggaaagctttagcggtgaaagatgggctcg

SEQ ID NO: 771 - DNA, 225 bp, Unknown
  Encodes 16S rRNA from Clostridium XlVa
agagtttgatcctggctcaggatgaacgctggcggcgtgcttaacacatgcaagtcgaacgaagcagctttgaaggagatttcggtcaatggataagctgacttagtggcggacgggtgagtaacgcgtgggcaacctgcctcatggagggggacaacagttggaaacgactgctaataccgcataagaccaagcatcgcatgatgcaatggtaaaagatttatc

SEQ ID NO: 772 - DNA, 225 bp, Unknown
  Encodes 16S rRNA from Rhodocista
agagtttgatcctggctcagaacgaacgctggcggcaggcttaacacatgcaagttgaacggtattgtgaagtgcttgcactgcacaagagagtagcgcactggtgagtaacacgtgggaacatgccctaaagtacgggatagcgtctggaaacggacgataatacggtatacgccctgagggggaaagatttatcgctttaggattggcccgcggaagattagg

SEQ ID NO: 773 - DNA, 225 bp, Unknown
  Encodes 16S rRNA from Clostridium XlVa
agagtttgatcatggctcaggatgaacgctggcggcgtgcctaacacatgcaagtcgaacgagcgccttcgggtgcgagtggcggacgggtgagtaacgcgtgggtaacctgccttacacagggggacaacagttggaaacgactgctaataccgcataagcccacggaaccgcatggttctgtgagaaaagatttatcggtgtaagatggacccgcgtctgatt

SEQ ID NO: 774 - DNA, 225 bp, Unknown
  Encodes 16S rRNA from Beijerinckia
agagtttgatcatggctcagaacgaacgctggcggcaggcttaacacatgcaagtcgaacggaacatagggtgcttgcactttatgtcagtggcgcacgggtgagtaacgcgtaggaacctgtcttttagcctgggatagcctctggaaacggagggtaaaaccggatgagccctgagggggaaatgagcaatcagctgaaagaggggcctgcgttagattaggc

SEQ ID NO: 775 - DNA, 225 bp, Unknown
  Encodes 16S rRNA from Lactobacillus
agagtttgatcctggctcaggacgaacgctggcggcgtgcctaatacatgcaagtcgaacgaagctttctttcaccgaatgcttgcattcaccgaaagaagcttagtggcgaacgggtgagtaacacgtaggcaacctgcccaaaagagggggataacacttggaaacaggtgctaataccgcataaccatgaacaccgcatgatgttcatgtaaaagacggctt

SEQ ID NO: 776 - DNA, 225 bp, Unknown
  Encodes 16S rRNA from Cryptanaerobacter
agagtttgatcatggctcaggacgaacgctggcggcatgcctaacacatgcaagtcgaacggaataggattggttgtagcgatactttcgatcctatttagtggcgaacgggtgagtaacacgtgagcaacctgccttttacacagggataacagccggaaacggctgctaataccggataagaccacaccgaggcatctcggaggggtcaaagcgatttagcgg

SEQ ID NO: 777 - DNA, 225 bp, Unknown
  Encodes 16S rRNA from Prevotella
agagtttgatcctggctcaggatgaacgctagctacaggcttaacacatgcaagtcgaggggcatcactgggttggcttgccatccctggtggcgaccggcgcacgggtgagtaacgcgtatccaacctgccccgaaccgcggtatagcccgccgaaaggcggattaatcccgcatgtggtcgtgagatgacatctgaccacgactaaaggtattttccggttcg

SEQ ID NO: 778 - DNA, 225 bp, Unknown
  Encodes 16S rRNA from Anaerovibrio
agagtttgatcctggctcaggacgaacgctggcggcgtgcttaacacatgcaagtcgaacggagcgaagaagagcttgctctttggagcttagtggcaaacgggtgagtaacgcgtaggcaacctgcccttcagatggggacaacacctcgaaaggggtgctaataccgaatgacgtgcattggtcgcatgaccgatgcaccaaaggccgggcaaccggtcactg

SEQ ID NO: 779 - DNA, 225 bp, Unknown
  Encodes 16S rRNA from Anaerovorax
agagtttgatcatggctcaggatgaacgctggcggcgtgcctaacacatgcaagtcgagcgggaatctctaaagcagcttgctgcggaagagaggatagcggcggacgggtgagtaacgcgtaggtaagctgccccttgcagaaggatagcctcgggaaactgggattaatacttcataacacggctggtccgcatgaaccggccgtcaaagatttatcggcaag

SEQ ID NO: 780 - DNA, 225 bp, Unknown
  Encodes 16S rRNA from Lachnospiracea incertae sedis
agagtttgatcctggctcaggatgaacgctggcggcgtgcttaacacatgcaagttgaacgaagaagtcagagtgcttgcactcaggcttactgagtggcggacgggtgagtaacgcgtgggtaacctgcctcacacagggggataacagtcggaaacgactgctaataccgcataagcgcacagtgccgcatgacacagtgtgaaaaactccggtggtgtgaga

SEQ ID NO: 781 - DNA, 225 bp, Unknown
  Encodes 16S rRNA from Enterorhabdus
agagtttgatcctggctcaggatgaacgctggcggcgtgcctaacacatgcaagtcgaacggttaaaccgccctcgggcggacataaagtggcgaacgggtgagtaacacgtgaccaacctgccccgcgcaccgggacagccccccgaaagggggattgataccggatactccgccgggcccgcatgggcccggcgggaaagctccggcggcgcgggatggggtc

SEQ ID NO: 782 - DNA, 225 bp, Unknown
  Encodes 16S rRNA from Clostridium XlVb
agagtttgatcctggctcaggatgaacgctggcggcgtgcataacacattcaagtcgaacgggacgttccgagtagcaatatgagggatgtttagtggcggacgggtgagtaacgcgtgagtaacctgcctgtgtgagggggacaacagatcgaaaggcctgctaataccgcatgacgtatggagatcgcatggttttcataccaaagatttatcgcacacagat

SEQ ID NO: 783 - DNA, 225 bp, Unknown
  Encodes 16S rRNA from Selenomonas
agagtttgatcatggctcaggacgaacgctggcggcgtgcttaacacatgcaagtcgaacgaggtgattgaaagcttgcttttgagaaccgagtggcaaacgggtgagtaacgcgtagacaacctgccgcaaagatggggacaacagtccgaaaggactgctaataccgaatgttgtcagattcccgcatgggagactgattaaagatggcctctacttgtaagc

SEQ ID NO: 784 - DNA, 225 bp, Unknown
  Encodes 16S rRNA from Eubacterium
agagtttgatcatggctcaggacgaacgctggcggcgtgcttaacacatgcaagtcgaacgaagcttgatttcagatttcttcggaatgacgaatgatatgactgagtggcggacgggtgagtaacgcgtgagcaacctaccctttggattgggatagcgtttggaaacgaacggtaataccgaataaagtatacggatggcatcatctgtataccaaagctccg

SEQ ID NO: 785 - DNA, 225 bp, Unknown
  Encodes 16S rRNA from Thermotalea
agagtttgatcatggctcaggatgaacgctggcggcgtgcctaacacatgcaagtcgagcgagaagttcgcaacggaagcttcggccgaagatgcggatggacagcggcggacgggtgagtaacgcgtaggtaagctgccctatgcacagggatagcctcgggaaactgggattaatacctgatgaagcggtaggtacacatgtactaatcgccaaagatttatc

SEQ ID NO: 786 - DNA, 225 bp, Unknown
  Encodes 16S rRNA from Enterorhabdus
agagtttgatcctggctcaggatgaacgctggcggcgtgcctaacacatgcaagtcgaacggttaagccggcttcggccgggaatacagtggcgaacgggtgagtaacacgtgaccaacctgccccccgcaccgggacagccccgcgaaagcgcggttaataccggataggcccccgcgcccgcatgggagcggggggaaagcccaggcggcgggggatggggtc

SEQ ID NO: 787 - DNA, 225 bp, Unknown
  Encodes 16S rRNA from Clostridium III
agagtttgatcatggctcaggacgaacgctggcggcgtgcctaacacatgcaagtcgagcgatgatcggaggatgagaccttcgggtggattcttccgagattagcggcggatgggtgagtaacgcgtgggcaatctgccctccacagggggataacacagggaaacttgtgctaataccgcataacatcttcgggaggcatcttctgaagatcaaaggagcgat

SEQ ID NO: 788 - DNA, 225 bp, Unknown
  Encodes 16S rRNA from Acetanaerobacterium
agagtttgatcctggctcaggacgaacgctggcggcgcgcctaacacatgcaagtcgaacggagatgaaaaaagcttgctttaatcatcttagtggcggacgggtgagtaacacgtgagcaacctgcctttcagagggggataacgtttggaaacgaacgctaataccgcataatgtatacggatggcatcgtctgtataccaaaggagcaatccgctgaaagat

SEQ ID NO: 789 - DNA, 225 bp, Unknown
  Encodes 16S rRNA from Treponema
agagtttgatcctggctcagaacgaacgctggcggcgcgtcttaagcatgcaagtcgggcgggattcatgtgcttgcacatgatgagagcggcggactggcgaggagcgcgtgggtgacgcaccccccggacggggacagccggcagaaatgccgggtgataccggatgaggtcccccttgttggaggagggggaggaaaggggcttcggccccgccgggggagc

SEQ ID NO: 790 - DNA, 225 bp, Unknown
  Encodes 16S rRNA from Clostridium XlVa
agagtttgatcatggctcaggatgaacgctggcggcgtgcctaacacatgcaagtcgaacggtgaaaggggacggaaccctccggggggaagtaacctggaacagtggcggacgggtgagtaacgcgtggataacctgcctcatacagggggataacagagagaaatcactgctaataccgcataagcgcacgagggccgcatggcccggtgtgaaaaactccgg

SEQ ID NO: 791 - DNA, 164 bp, Unknown
  Encodes 16S rRNA from Enterorhabdus
agagtttgatcatggctcaggatgaacgctggcggcgtgcctaacacatgcaagtcgaacgaagcacttttgcattcgaggaagacagcgtataaataaatgcgctatttgacgttagagtgtgaataagcaccggcaaactccgtgccagcagccgcggtaat

SEQ ID NO: 792 - DNA, 225 bp, Unknown
  Encodes 16S rRNA from Prevotella
agagtttgatcatggctcaggatgaacgctagctacaggcttaacacatgcaagtcgaggggcagcatgaacttagcttgctaagtttgatggcgaccggcgcacgggtgagtaacgcgtatccaacctgccccgaggtcagggacagcccggcgaaagtcggattaatacctgatggtctctttagatggcatctgacgaggagtaaagattcatcgccttggg

SEQ ID NO: 793 - DNA, 225 bp, Unknown
  Encodes 16S rRNA from Desulfovibrio
agagtttgatcctggctcaggacaaacgctggcggcgtgcctaacacatgcaagtcgaacgagcccttcggggctagtggcagacgggtgagtaacgcgtaggtaatgtacctcttcgctggggataccgttccgaaaggaacgttaataccgaatgaattcatcgggcggcatcgcttgatgaataaaccgcaagggcgaggagatcagcttgcgtactatcag

SEQ ID NO: 794 - DNA, 225 bp, Unknown
  Encodes 16S rRNA from Aminobacter
agagtttgatcatggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgttggattagctagttggtggggtaatgg

SEQ ID NO: 795 - DNA, 225 bp, Unknown
  Encodes 16S rRNA from Clostridium IV
agagtttgatcctggctcaggacgaacgctggcggcgtgcctaacacatgcaagtcgaacggagatattcgaatgagattcgttgattttgaatatcttagtggcggacgggtgagtaacgcgtgagtaacctgccgatgagtgtggaataacgttctgaaaagaacgctaataccgcataacatatttttgccgcatgacagaagtatcaaagatttatcgctc

SEQ ID NO: 796 - DNA, 225 bp, Unknown
  Encodes 16S rRNA from Rikenella
agagtttgatcatggctcaggatgaacgctagcggcaggcttaacacatgcaagtcgaggggcagcgcgaggtagcaatactttggcggcgaccggcgcaagggtgcgtaacgcgtgagcaacttgcccgtaacaggaggataaccggaggaaactccgactaatactgcgtagaaataattggtggcatcaccgagtgtttaaaggcgaaagccggttacggat

SEQ ID NO: 797 - DNA, 225 bp, Unknown
  Encodes 16S rRNA from Gordonibacter
agagtttgatcatggctcaggatgaacgctggcggcgtgcctaacacatgcaagtcgaacgattaaaccgccttcgggcggatataaagtggcgaacgggtgagtaacacgtaaccaacctaccccgcacactgggacagcctcgcgaaagcgggattaataccagatactccttatgttacgcatgttttataagggaaagcttttgcggtgcgggatggggtt

SEQ ID NO: 798 - DNA, 225 bp, Unknown
  Encodes 16S rRNA from Papillibacter
agagtttgatcctggctcaggatgaacgctggcggcgtgcataacacattcaagtcgaacgaagcatatggttggaagttttcggacggaagagcatatgacttagtggcggacgggtgagtaacgcgtgagcaaccttcctgcatgtgagggataacacagggaaacttgtgctaataccgcataacgcatgactgtcgcatggcagacatgccaaagaataat

SEQ ID NO: 799 - DNA, 225 bp, Unknown
  Encodes 16S rRNA from Syntrophococcus
agagtttgatcatggctcaggatgaacgctggcggcgtgcctaacacatgcaagtcgaacgaggctcttccctttgaagtttcgacagattagggaagatcaccgagtggcggatgggtgagtaacgcgtggagaacctgcccccatcagggggataacaactggaaacggttgataataccgcatatatgataggaccgcatgattctatcaggaaagatttat

SEQ ID NO: 800 - DNA, 225 bp, Unknown
  Encodes 16S rRNA from Clostridium sensu stricto
agagtttgatcatggctcaggatgaacgctggcggcgtgtttaatacatgcaagtcgaacgaggtatagcaatataccgagtggcgaacgggtgagtaacacgtgagcaacctgccctatacagggggacaacagctggaaacggctgctaataccgcataagaccacagcatcgcatgatgcaggggtaaaaggctacggtcagtataggatgggctcgcgcac

SEQ ID NO: 801 - DNA, 154 bp, Unknown
  Encodes 16S rRNA from Hahella
agagtttgatcatggctcagattgaacgctggcggcaggcttaacacatgcaagtcgtacggtaacagaggaagacagcacgtaaataaacgtgttatttgacgttagagtgtgaataagcaccggcaaactccgtgccagcagccgcggtaat

SEQ ID NO: 802 - DNA, 225 bp, Unknown
  Encodes 16S rRNA from Vampirovibrio
agagtttgatcatggctcaggacgaacgctggcggtgtgcctcatacatgcaagtcgaacgataaggtttcttcggaaatacataagtggcggacgggtgagtacaacataggaaatctgccctaaactgggggacaacagagggaaacttctgctaataccccatacgagctagcttgaaatagctatcttgaaagctccggcggtttaggatgagcctgtgcc

SEQ ID NO: 803 - DNA, 225 bp, Unknown
  Encodes 16S rRNA from Coprococcus
agagtttgatcatggctcaggatgaacgctggcggcgtgcctaacacatgcaagtcgaacggggtgtcaatcttcggaaagacacttagtggcggacgggtgagtaacgcgtgggtaacctgcctcatacagggggatagcagttggaaacgactgataataccgcataagcgcacagtaccgcatggtacagtgtgaaaaactccggtggtatgagatggaccc

SEQ ID NO: 804 - DNA, 225 bp, Unknown
  Encodes 16S rRNA from Coraliomargarita
agagtttgatcatggctcagagtgaacgctggcgacgtggctaagacatgcaagtcgagcgagaaggtgccttcgggtgccggaaagcggcaaacgggtgcgtaacacgtaagtaacctgcccttaagacgggaatagcttgatgaaaattgagataatgcccgatattaaattcttccgcatggaagaggtttgaaaggtttgtgatggcgcttaaggaggggc

SEQ ID NO: 805 - DNA, 225 bp, Unknown
  Encodes 16S rRNA from Clostridium III
agagtttgatcctggctcaggacgaacgctggcggcgtgcctaacacatgcaagtcgagcggagccatcttgaagatcccttcggggtgatttaggggaagcttagcggcggacgggtgagtaacacgtgagtaacctgcccttatgaggaggataacacaccgaaaggtgtgctaatactgcataatatatatttttcgcatggagaatatatcaaagatttat

SEQ ID NO: 806 - DNA, 225 bp, Unknown
  Encodes 16S rRNA from Clostridium XlVa
agagtttgatcatggctcaggatgaacgctggcggcgtgcctaacacatgcaagtcgaacgaagctttgcttatgattttttcggaatgattaagtgaatgactgagtggcggacgggtgagtaacgcgtggataacctgccctttgcagggggataacagccggaaacgactgctaataccgcataagcgcacagcaccgcatggtgcagtgtgaaaaactccg

SEQ ID NO: 807 - DNA, 225 bp, Unknown
  Encodes 16S rRNA from Desulfotomaculum
agagtttgatcctggctcaggacgaacgctggcggcgtgcttaacacatgcaagtcgaacggagcggagcccttcggggccgagcttagtggcggacgggtgagtaacacgtgagcaacctgcccattacagggggatagcagctggaaacggctggtaataccgcataagaccgcggaaccgcatggttcagaggtaaaaggagagatccggtaatggatgggc

SEQ ID NO: 808 - DNA, 225 bp, Unknown
  Encodes 16S rRNA from Helicobacter
agagtttgatcatggctcagagttaacgctggcggcgtgcctaacacatgcaagtcgagcgagtgcttgtaaagactagcggcaaacgggtgagtaacacatgggaaaccttccttagaatgggggacatctccgtgaaaacggagctaataccgcataagaccacagtttggcatcagacaggggtaaaagcagtgatgtgttctaagatggtcctgtgtccta

SEQ ID NO: 809 - DNA, 225 bp, Unknown
  Encodes 16S rRNA from Syntrophococcus
agagtttgatcatggctcaggatgaacgctggcggcgtgcctaacacatgcaagtcgaacgggaacctcatagtggagacttcggtcaaagcagtgagaattctagtggcggatgggtgagtaacgcgtgggtaacctgcctacaagaattggataacagcgagaaattgttgctaatacaatataagcttacagtatcgcatgatacagtgagaaaagatttat

SEQ ID NO: 810 - DNA, 208 bp, Unknown
  Encodes 16S rRNA from Lachnospiracea incertae sedis
agagtttgatcctggctcaggatgaacgctagctacaggcttaacacatgcagcagtggggaatattgcacaatggaggaaactctgatgcagcgacgccgcgtgagcgatgaagtatttcggtatgtaaagctctatcagcagggaagataatgacggtacctgactaagaagctccggctaaatacgtgccagcagccgcggtaat

SEQ ID NO: 811 - DNA, 225 bp, Unknown
  Encodes 16S rRNA from Clostridium IV
agagtttgatcatggctcaggatgaacgctggcggcgtgcttaacacatgcaagtcgaacggagctatattggaaggaccttcggggacggaagatatagcttagtggcggacgggtgagtaacgcgtgagtaacctggcctcaagagggggacaacagctggaaacggctgctaataccgcataacataatggagtcgcatggctctgttatcaaaggagcaat

SEQ ID NO: 812 - DNA, 225 bp, Unknown
  Encodes 16S rRNA from Paludibacter
agagtttgatcatggctcaggatgaacgctagcgacaggcctaacacatgcaagtcgaggggcagcacgagtgaagcttgctttacttggtggcgaccggcgcacgggtgcgtaacgcgtatgcaacctgtccataaccgagggatagcctcccgaaagggagattaaaacttcatgtgccacatgagggcatccgagagtggtaaaacgtttgggttatggttg

SEQ ID NO: 813 - DNA, 225 bp, Unknown
  Encodes 16S rRNA from Lachnospiracea incertae sedis
agagtttgatcatggctcaggatgaacgctggcggcgtgcctaacacatgcaagtcgaacgggactcatagtgacggagatttcggtcaaagaagctttgagtccagtggcggacgggtgagtaacgcgtggggaacctgccctgtaccgggggataacagtgagaaatcactgctaataccgcataagcgcacatggtcgcatgaccgggtgtgaaaagctccg

SEQ ID NO: 814 - DNA, 225 bp, Unknown
  Encodes 16S rRNA from Lachnospiracea incertae sedis
agagtttgatcctggctcaggatgaacgctggcggcgcgcttaacacatgcaagtcgaacgagatgagtggcttcggtcatgaatctagtggcggacgggtgagtaacgcgtggacaacttgccttatagtgggggatagccgaaagaaatttcgattaataccgcataatacaatttggttgcatgatcagattgggaaaggcttcggtcgctaaaagaaaggt

SEQ ID NO: 815 - DNA, 225 bp, Unknown
  Encodes 16S rRNA from Adhaeribacter
agagtttgatcctggctcaggatgaacgctggcggcaggcttaatacatgcaagtcgaacggtaaggtccgaggtagcaataccgaggatacacgagtggcgcacgggtgcgtaacgcgtatgcaacctacctttgactggaacataacgttgagaaatcggcgctaatattccatgtggttatgacccggcatcgggatgtaactaaagatttattggtcaagg

SEQ ID NO: 816 - DNA, 225 bp, Unknown
  Encodes 16S rRNA from Clostridium IV
agagtttgatcatggctcaggatgaacgctggcggcgtgcataacacattcaagtcgaacggacatattgacttcggttggtatgttagtggcggacgggtgagtaacgcgtgagcaacctgcccctatgtgcgggataacggctggaaacggacgctaataccgcataacccaacggaaccgcatgattttgttggcaaagatttattgcatagggatgggctc

SEQ ID NO: 817 - DNA, 225 bp, Unknown
  Encodes 16S rRNA from Cryptanaerobacter
agagtttgatcatggctcaggacgaacgctggcggcgtgcttaatacatgcaagtcgaacggatatgtagcaatacatattagtggcggacgggtgagtaacgcgtaaccaacctgccttttacaggggaataacacttggaaacaggtgctaataccgcatatgaccacaacgcggcatcgcgaaggggtaaaagttttatcggtaaaagagggggttgcgtat

SEQ ID NO: 818 - DNA, 225 bp, Unknown
  Encodes 16S rRNA from Idiomarina
agagtttgatcggccacattgggactgagacacggcccagactcctacgggaggcagcagtggggaatattgcacaatgggggaaaccctgatgcagccatgccgcgtgtgtgaagaaggccttcgggttgtaaagcacttttgcattcgaggaagacagcgtataaataaatgcgctatttgacgttagagtgtgaataagcaccggcaaactccgtgccagca

SEQ ID NO: 819 - DNA, 225 bp, Unknown
  Encodes 16S rRNA from Clostridium IV
agagtttgatcatggctcaggacgaacgctggcggcgtgcttaacacatgcaagtcgaacgaggaatgtttgaaagcttgcttttgaacatttcgagtggcggacgggtgagtaacgcgtgaggaacctgtctttcacagggggataacgttccgaaagggacgctaataccgcatgagaccacggtgccgcatggcacaggggtcaaaggagagatccggtgaa

SEQ ID NO: 820 - DNA, 225 bp, Unknown
  Encodes 16S rRNA from Selenomonas
agagtttgatcctggctcaggacgaacgctggcggcgtgcttaacacatgcaagtcgaacgaggtgattgaaagcttgcttttgagaaccgagtggcaaacgggtgagtaacgcgtagacaacctgccgcaaagatggggacaacagtccgaaaggactgctaataccgaatgttgtcagtttctcgcatgagagactgattaaagatggcctctacttgtaagc

SEQ ID NO: 821 - DNA, 225 bp, Unknown
  Encodes 16S rRNA from Acetanaerobacterium
agagtttgatcctggctcaggataaacgctggcggcgtgcataacacattcaagtcgaacgaagcacttcggaacgagacttcggtcaagggaagatttgacttagtggcggacgggtgagtaacgcgtgagcaatctgcctcggggtgcgggataacgtttggaaacgaacgctaataccgcatgacgcatacctttcgcatgtgaggtatgccaaaggtttac

SEQ ID NO: 822 - DNA, 225 bp, Unknown
  Encodes 16S rRNA from Bifidobacterium
agagtttgatcatggctcaggatgaacgctggcggcgtgcttaacacatgcaagtcgaacgggatcggctggagcttgctccggccgtgagagtggcgaacgggtgagtaatgcgtgaccgacctgccccgtacaccggaatagctcctggaaacgggtggtaatgccggatgctccaatgcgatgcatgtcgcgttgggaaagatttcatcggtatgggatggg

SEQ ID NO: 823 - DNA, 225 bp, Unknown
  Encodes 16S rRNA from Clostridium XlVb
agagtttgatcatggctcaggatgaacgctggcggcgtgcctaacacatgcaagtcgagcgaagaatgagaagcttgcttttcattacttagcggcggacgggtgagtaacgcgtgggtaacctgccctgtacaggggaataacagttagaaatgactgctaatgccccataagccgacgtaatggcatctttatgtcggaaaagatttatcggtacaggaggga

SEQ ID NO: 824 - DNA, 225 bp, Unknown
  Encodes 16S rRNA from Asaccharobacter
agagtttgatcatggctcaggatgaacgctggcggcgtgcttaacacatgcaagtcgaacgattaaaccggcttcggccggatatagagtggcgaacgggtgagtaacacgtgaccaacctaccccatactccgggataactcagggaaacttgtgctaataccggatactccgagaggatcgcatgttcttttcgggaaagcctttacggtatgggatggggtc

SEQ ID NO: 825 - DNA, 225 bp, Unknown
  Encodes 16S rRNA from Eubacterium
agagtttgatcctggctcaggatgaacgctggcggcgtgcttaacacatgcaagtcgaacggaactcactttctgaagttttcggatggatgaaggtaagtttagtggcggacgggtgagtaacgcgtgggtaacctgccctgtacagggggataacagttagaaatgactgttaataccgcataagaccacagcaccgcatggtgcaggggtaaaagctccgac

SEQ ID NO: 826 - DNA, 225 bp, Unknown
  Encodes 16S rRNA from Anaeroplasma
agagtttgatcctggctcaggattaacgctggcggcgtgcctaatacatgcaagtcgaatggtagtagcaatacaaaccatggcgaacgggtgagtaacacgtaggtaacctgtctttaagacgaggataaccattggaaacgatggataatactggataggacatcataaagggcatccttagatgtttaaagattattatgtcacttagagaggggcctgcgg

SEQ ID NO: 827 - DNA, 225 bp, Unknown
  Encodes 16S rRNA from Saccharofermentans
agagtttgatcatggctcaggacgaacgctggcggcgtgcctaacacatgcaagtcgagcggagtaagtggagagcttgcttgaaacttacttagcggcggacgggtgagtaacgcgtgagcaacctgtcctctgcagggggataagacagcgaaagttgttctaataccgcataagaccacaacgtcacatggcgaaggggtcaaaggaggaatccggcagagg

SEQ ID NO: 828 - DNA, 225 bp, Unknown
  Encodes 16S rRNA from Ruminococcus
agagtttgatcatggctcaggacgaacgctggcggcacgcctaacacatgcaagtcgaacggtgtcggaggtgcttgcaccaatgacatagtggcggacgggtgagtaacacgtgagcaacctgccttcaagaaagggatagcttctggaaacggatggtaataccttataatatatactggccgcatgaccggtgtatcaaacgaattttgcttgaagatgggc

SEQ ID NO: 829 - DNA, 225 bp, Unknown
  Encodes 16S rRNA from Clostridium III
agagtttgatcctggctcaggacgaacgctggcggcgtgcctaacacatgcaagtcgagcggaggaaaccgaaagaagccttcgggtggattttggtggacttagcggcggacgggtgagtaacgcgtgagtaacctgcccataagagggggataatccttggaaacggggactaataccgcatatagagtatttgttgcatgattgatacttgaaagatttatc

SEQ ID NO: 830 - DNA, 225 bp, Unknown
  Encodes 16S rRNA from Acholeplasma
agagtttgatcatggctcaggattaacgctggcggcatgcctaatacatgcaagtcgaacggtctagcttgctagacagtggcgaacgggtgagtaacacgtaggtaatccacccttaggacgaggatagcttctggaaacggaaggtaaaactggatagtatatagggaggcatcttcttatatttaaaagagcaatctacctaaggaagagcctgcggcgcat

SEQ ID NO: 831 - DNA, 225 bp, Unknown
  Encodes 16S rRNA from Pedobacter
agagtttgatcctggctcaggatgaacgctagcggcaggcttaacacatgcaagtcgaggggcagcgggccgtagcaatacggtgccggcgaccggcggacgggtgcgtaacgcgtatgcaaccttccctgcacaggggtatagcccggcgaaagccggaataatcccccatagtttcaattttccgcatggagagttggataaacgggcgaccgggtgcaggat

SEQ ID NO: 832 - DNA, 225 bp, Unknown
  Encodes 16S rRNA from Sphingomonas
agagtttgatcatggctcagagcgaacgctagcggcatgctttatacatgcaagtcgaacgaacgagtttatattgagtagcaatacgatttatgaatgagttagtggcgaacgggtgagtaatatataggaatttgcccagtagtgggggacaacagttagaaatgactgctaataccgcatacgcccgagaggggaaagatttatcgctattggagaagccta

SEQ ID NO: 833 - DNA, 225 bp, Unknown
  Encodes 16S rRNA from unknown taxa
agagtttgatcctggctcagaacgaacgctggtagcgtggattaggcatgcaagtcgaacgggatccgggaggtagcaatacttcctggtgagagtggcggattggggaggaacacgtgagcaacctgccttggagtcggggaaaaccgttggaaacgacggctaataccggatgtggcgcccggtgacatcatcggagcgctaaagggggccgcaaggctctcg

SEQ ID NO: 834 - DNA, 225 bp, Unknown
  Encodes 16S rRNA from Anaerovorax
agagtttgatcatggctcaggatgaacgctggcggcgtgcctaacacatgcaagtcgagcgggaaatcctcaaaggaagcttcggcagactgagaggatggatagcggcggacgggtgagtaacgcgtaggtaagctgccccatgcacagggatagcctcgggaaactgggattaatacctgatgacaccgcgcattcacatggatatgcggtcaaagatttatc

SEQ ID NO: 835 - DNA, 225 bp, Unknown
  Encodes 16S rRNA from Spirochaeta
agagtttgatcatggctcagaacgaacgctggcggtgcgtcttaagcatgcaagtcggacggcaagatagtagcttgctactatcctagagtggcggactggtgagtaacacgtgggtgacataccctttggctggggatagccggtagaaataccgggtaataccgaataagattctgcaggttagagtggcagaaagaaaggagcttcggcttcaccgaagga

SEQ ID NO: 836 - DNA, 225 bp, Unknown
  Encodes 16S rRNA from Paraeggerthella
agagtttgatcctggctcaggatgaacgctggcggcgtgcctaacacatgcaagtcgaacggttaaggcgccttcgggcgcgaatagagtggcgaacgggtgagtaacacgtgaccaacctgccccgcgctccgggacagcctcgggaaaccgggattaataccggatgcgccggggggcgcgcatgcgccccccgggaaagcccaggcggcgcgggatggggtc

SEQ ID NO: 837 - DNA, 225 bp, Unknown
  Encodes 16S rRNA from Lachnospiracea incertae sedis
agagtttgatcctggctcaggatgaacgctggcggcgcgcctaacacatgcaagtcgaacgaaatgagtagcttcggttacaagtttagtggcggacgggtgagtaacgcgtggataatttgcctttcagtgggggatagctgagagaaatctcaattaataccgcataacataatttattcgcatgagtgagttattaaagatgcaagtcgctggaagagaagt

SEQ ID NO: 838 - DNA, 225 bp, Unknown
  Encodes 16S rRNA from Bacteroides
agagtttgatcctggctcaggatgaacgctagctacaggcttaacacatgcaagtcgaggggcagcattgaggttgcttgcaacttcagatggcgaccggcgaatgggtgagtaacgcgtatccaacctgccgtgtgctctgggatagcccttagaaatgaggattaatacgagatagtctcctttgatcgcctgagattaggagtaaagattcatcggcacacg

SEQ ID NO: 839 - DNA, 225 bp, Unknown
  Encodes 16S rRNA from Paenibacillus
agagtttgatcatggctcaggatgaacgctggcggcgtgcctaatacatgcaagtcgaacggactgtagcaatacagttagtggcgaacgggtgagtaacacgtaggtaacctgccctcaagactgggatacccagacgaaagtttggctaataccggataacaactctggaggcatctctggagtttgaaaggcgcctttaaagcgccacttaaggatggacct

SEQ ID NO: 840 - DNA, 225 bp, Unknown
  Encodes 16S rRNA from Prevotella
agagtttgatcctggctcaggatgaacgctagctacaggcttaacacatgcaagtcgaggggcagcatgaagattgcttgcaatctttgatggcgaccggcgcacgggtgcgtaacgcgtatcgaacctgccctgtacacggggatagccttgcgaaagcaagattaatacccgatgttttggcgatgccgcatgacattaccaacaaagatttatcggtacagg

SEQ ID NO: 841 - DNA, 225 bp, Unknown
  Encodes 16S rRNA from Bacteroides
agagtttgatcatggctcaggatgaacgctagctacaggcttaacacatgcaagtcgaggggcagcatgaacttagcttgctaagtttgatggcgaccggcgcacgggtgagtaacgcgtatccaaccttccgtttactcggggatagcctttcgaaagaaagattaatacccgatggtatggtaatattgcatgataataccattaaagattaattggtaaacg

SEQ ID NO: 842 - DNA, 225 bp, Unknown
  Encodes 16S rRNA from Clostridium XlVa
agagtttgatcctggctcaggatgaacgctggcggcgtgcttaacacatgcaagtcgaacgaagcatcccttgaaattttcggatggatggggatgacttagtggcggacgggtgagtaacgcgtgggtaacctgcctcatgcagggggacaacagctggaaacggctgctaataccgcataagaccccgtgagcgcatgctcaagaggtaaaagatttatcggc

SEQ ID NO: 843 - DNA, 225 bp, Unknown
  Encodes 16S rRNA from Clostridium XlVa
agagtttgatcatggctcaggatgaacgctggcggcgtgcttaatacatgcaagtcgaacgggatagattgggagcttgctcttgatttatctagtggcggacgggtgagtaacgcgtgggtaacctgcctcatacagggggataacagttagaaatgactgctaaaaccgcataacattatggtaccgcatgatatcatgatcaaatatttataggtatgagat

SEQ ID NO: 844 - DNA, 225 bp, Unknown
  Encodes 16S rRNA from Roseburia
agagtttgatcctggctcaggatgaacgctggcggcgtgcttaacacatgcaagtcgaacgaggtttaagcggaagcccttcgggacggaagcttttaccgagtggcggacgggtgagtaacgcgtgggtaacctgccctgtactgggggacaacagttggaaacgactgctaataccgcataagcgcacgagatcgcatggttttgtgtgaaaaactccggtgg

SEQ ID NO: 845 - DNA, 225 bp, Unknown
  Encodes 16S rRNA from Clostridium XlVa
agagtttgatcatggctcaggatgaacgctggcggcgtgcctaacacatgcaagtcgaacggggtacagacgctgtgagaagaagtgcttgcacggaatcaaacttgtttgtacttagtggcggacgggtgagtaacgcgtggaaaacctgcctcatacagggggataacaggaagaaattcctgctaataccgcataagcgcacaaggtcgcatgatcaggtgt

SEQ ID NO: 846 - DNA, 225 bp, Unknown
  Encodes 16S rRNA from Clostridium III
agagtttgatcatggctcaggacgaacgctggcggcgtgcctaacacatgcaagtcgaacggggaagagaagcttgcttttctttctagtggcggacgggtgagtaacgcgtgagcaacctacctatcagtgggggataacgtctggaaacagacgctaataccgcatatcgtacataattcgcatgaataagtgtatgaaaggagtaatttgctggtagatggg

SEQ ID NO: 847 - DNA, 225 bp, Unknown
  Encodes 16S rRNA from Pedobacter
agagtttgatcctggctcaggatgaacgctagcggcaggcctaatacatgcaagtcgaacggtaaacgccccttcgggggtgtgagagtggcgcacgggtgcgtaacgcgtatgcaacccacccgctgccgggggatagcccggagaaatccgaattaataccccatgaggaggaggtgaggcatctcatctttttcaaaacttcggtggcggcggacgggcatg

SEQ ID NO: 848 - DNA, 225 bp, Unknown
  Encodes 16S rRNA from Robinsoniella
agagtttgatcatggctcaggatgaacgctggcggcacgcttaacacatgcaagtcgagcggagaacagacttcggtttgttcttagcggcggacgggtgaggaacgcgtgggtaatctgccctatacaggggaataacactgagaaattagtgataaagccgcataagcccacgggatcgcatgatcctgcgggaaaaactccggtggtataggatgagcccgc

SEQ ID NO: 849 - DNA, 225 bp, Unknown
  Encodes 16S rRNA from Anaeroplasma
agagtttgatcctggctcaggattaacgctggcggcatgcctaatacatgcaagtcgaacggaactagcttgctagttcagtggcgaacgggtgagtaacacgtaggtaatctacctttaggacgaggatagcttctggaaacggaaggtaaaactggatagtatattagagggcatcctttaatatttaaaagagcaatctacctagagaggagcctgcggccc

SEQ ID NO: 850 - DNA, 225 bp, Unknown
  Encodes 16S rRNA from Clostridium XlVa
agagtttgatcctggctcaggatgaacgctggcggcgtgcctaacacatgcaagtcgaacggagtgcattaagcagattcttcggatgaagctttttacacttagtggcggacgggtgagtaacgcgtggagaacctgcctcacacagggggacagcagctggaaacggctgataataccgcatatgcccacgataccgcatggtattgcggggaaacatttatg

SEQ ID NO: 851 - DNA, 225 bp, Unknown
  Encodes 16S rRNA from Hydrogenoanaerobacterium
agagtttgatcatggctcaggacgaacgctggcggcgcgcttaacacatgcaagtcgtacgaaatcagcaatggtttagtggcggacgggtgagtataacatgaataacttgcctcagagtgggggatagcttctggaaacagaagataataccgcatatttcgaatttttctcatgaatttttcggtaaagaagctttttcgctctgagatgggttcatgcccg

SEQ ID NO: 852 - DNA, 225 bp, Unknown
  Encodes 16S rRNA from Turicibacter
agagtttgatcatggctcaggatgaacgctggcggcgtgcctaatacatgcaagtcgaacgaggttggtagcaatatcaaccgagtggcgaacgggtgagtaacacgtagggaacctgccctttagtttgggatacccagaggaaactttggctaataccggataattgttctggaggcatctccggaatctgaaaggggcctttaaagcctcgcttaaggatgg

SEQ ID NO: 853 - DNA, 225 bp, Unknown
  Encodes 16S rRNA from Papillibacter
agagtttgatcatggctcaggataaacgctggcggcgtgcttaacacattcaagtcgaacggacggaggggagcttgctcccccgagttagtggcggacgggtgagtaacgcgtgagcaacctgccttttttcgggggataacacggggaaaccggtgctaataccgcataaagtaccgacatcgcatggtgatggtaccaaaggagcaatccgaggaaagatgg

SEQ ID NO: 854 - DNA, 225 bp, Unknown
  Encodes 16S rRNA from Clostridium XlVa
agagtttgatcctggctcaggatgaacgctggcggcgtgcctaacacatgcaagtcgagcggacttatgataagattcttcggatgatttttataagttagcggcggatgggtgaggaacgcgtggagaacctgcccttcacagggggataacagctggaaacggctgttaataccgcatatgctcacggtggcgcatgtcacagggaggaaagctccggcggtg

SEQ ID NO: 855 - DNA, 225 bp, Unknown
  Encodes 16S rRNA from Saccharofermentans
agagtttgatcatggctcaggacgaacgctggcggcgtgcctaacacatgcaagtcgagcgaggacaagggcttcggttcttgttcgagcggcggacgggtgagtaacgcgtgaacaatctgtccctgacaggggaataacacttggaaacaggtgctaataccgcataagaccacgggttcgcatgaaccaggggtaaaaggagagatccggtgaggggtgagt

SEQ ID NO: 856 - DNA, 225 bp, Unknown
  Encodes 16S rRNA from Clostridium XlVb
agagtttgatcatggctcaggatgaacgctggcggcgtgcctaacacatgcaagtcgagcgaagttttagggaagcttgctttccgaagaacttagcggcggacgggtgagtaacgtgtgggtaacttgccctatgcagagggataacagtgagaaatcactgctaatacctcataagctcacaccttcacatggaggagtgagaaaagatttatcggcatagga

SEQ ID NO: 857 - DNA, 225 bp, Unknown
  Encodes 16S rRNA from Sporobacter
agagtttgatcctggctcaggatgaacgctggcggcgtgcctaacacattcaagtcgaacggagaagggagcttcggctcccggatcagtggcggacgggtgagtaacgcgtgagcaacctgccttcgtgtggggaataacacagggaaacttgtgctaataccgcataatgcaaagacatagcattgtgactttgccaaagatttattgcatgaagatgggctc

SEQ ID NO: 858 - DNA, 225 bp, Unknown
  Encodes 16S rRNA from Asaccharobacter
agagtttgatcatggctcaggatgaacgctggcggcgtgcttaacacatgcaagtcgaacgagaaagcaccttcgggtgtaagtagagtggcgaacgggtgagtaacacgtgagcaacctgcctctcactttggaataactcagagaaatttgagctaataccgaatacttcgtatctttcgcatgatcgatacgagaaagccttgtgcggtgagagatgggctc

SEQ ID NO: 859 - DNA, 225 bp, Unknown
  Encodes 16S rRNA from Bacteroides
agagtttgatcatggctcaggatgaacgctagctacaggcttaacacatgcaagtcgaggggcagcattaggtcagcttgctgatttagatggcgaccggcgcacgggtgagtaacgcgtatccaacctgccccctacccggggatagccttgcgaaagtaagattaatacccggtgctgttgcgatcccgcatggggatgcaacgaaagattcatcggtagggg

SEQ ID NO: 860 - DNA, 225 bp, Unknown
  Encodes 16S rRNA from Anaeroplasma
agagtttgatcatggctcaggattaacgctggcggcatgcctaatacatgcaagtcgaatgggaagcttgctttccatggcgaacgggtgagtaacacgtaggtaagccatacatcagacgaggataacctttggaaacgaaggataatactggataggatatttgatcgcatgattaaatatttaaagatttatcactgatggaagcacctgcggcgcattagc

SEQ ID NO: 861 - DNA, 225 bp, Unknown
  Encodes 16S rRNA from Sporobacter
agagtttgatcctggctcaggacgaacgctggcggcgtgcctaacacatgcaagtcgaacgagaattcccggaaggagacttcggtcaacggaagggaaggacagtggcggacgggtgagtaacgcgtgagcaacctgcccttcggagggggacaacagctggaaacggctgctaataccgcataacgtatcacacaggcatctgagagataccaaagatttatc

SEQ ID NO: 862 - DNA, 225 bp, Unknown
  Encodes 16S rRNA from Streptomyces
agagtttgatcctggctcaggacgaacgctggcggcgtgcttaacacatgcaagtcgaacgatgaagccgcttcggtggtggattagtggcgaacgggtgagtaacacgtgggcaatctgccctgcactctgggataagccctggaaacggggtctaataccggatgggactgctgggggcatcctctggtggtggaaagcttcggtggtgcaggatgagcccgc

SEQ ID NO: 863 - DNA, 225 bp, Unknown
  Encodes 16S rRNA from Arcobacter
agagtttgatcctggctcagagtgaacgctggcggcgtgcttaacacatgcaagtcgaacgagaacggattatagcttgctataattgtcagctaagtggcgcacgggtgagtaatgtataggtaatatgcctcttactaagggataacaattggaaacgattgctaataccttatattcctttttatcaaaagataaaaagggaaagatttattggtaagagat

SEQ ID NO: 864 - DNA, 225 bp, Unknown
  Encodes 16S rRNA from Clostridium XlVa
agagtttgatcctggctcaggatgaacgctggcggcgtgcctaacacatgcaagtcgaacggacccatggaaatgattagcttgctatgaaattccggaaggttagtggcggacgggtgagtaacgcgtgggcaacctgccctgtactgggggatagcagctggaaacggctggtaataccgcataagcgcacagtaccgcatggtacagtgtgaaaagctccga

SEQ ID NO: 865 - DNA, 225 bp, Unknown
  Encodes 16S rRNA from Barnesiella
agagtttgatcatggctcaggatgaacgctagcgacaggcctaacacatgcaagtcgaggggcagcgggagcaaagcttgctttgcttgccggcgaccggcgcacgggtgagtaacgcgtatgcaacctgcctgtaacagggggataacccggagaaatccggcctaacaccgcataacacatgtaagccgcatggttttcatgtcaaatattcgtaggttacag

SEQ ID NO: 866 - DNA, 225 bp, Unknown
  Encodes 16S rRNA from Lactobacillus
agagtttgatcatggctcaggacgaacgctggcggcgtgcctaatacatgcaagtcgagcgagcggaaccaacagatttacttcggtaatgacgttgggaaagcgagcggcggatgggtgagtaacacgtggggaacctgcccctaagtctgggataccatttggaaacaggtgctaataccggataagaaagcagatcgcatgatcagcttttaaaaggcggcg

SEQ ID NO: 867 - DNA, 225 bp, Unknown
  Encodes 16S rRNA from Flavobacterium
agagtttgatcatggctcaggatgaacgctagcggcaggcttaacacatgcaagtcgaggggtaacaggcggtagcaatactgtgctgacgaccggcgcacgggtgcgtaacgcgtatgcaacctgcccgcgacagggggataacggagggaaacttccactaatatcccatggtgccgaggtctcgcatggggtttcggctaaaggggcgacccggttgcggat

SEQ ID NO: 868 - DNA, 225 bp, Unknown
  Encodes 16S rRNA from Victivallis
agagtttgatcatggctcagaatgaacgctggcggcatggattaggcatgcaagtcgaacgccccgggcttgcccggggagtggcgaaagggtgcgcaacacgtgaggaacccgcccccgggtccgggacaagcgctggaaacggcgtctaataccggatgccgaccggaatcgcatgattccgcgtcgaaagtcttctcgcccggggaaggcctcgcgtcccat

SEQ ID NO: 869 - DNA, 225 bp, Unknown
  Encodes 16S rRNA from Clostridium XlVa
agagtttgatcctggctcaggatgaacgctggcggcgtgcctaacacatgcaagtcgaacgatgaaatacggagacgagttttcggacgagaggaagtatggaatagtggcggacgggtgagtaacgcgtggataatctgccccatacagggggatagcagttggaaacgactgataacaccgcataagcgcacggagaggcatctctttgtgtgaaaatctacg

SEQ ID NO: 870 - DNA, 225 bp, Unknown
  Encodes 16S rRNA from Ureaplasma
agagtttgatcctggctcaggattaacgctggcaccatgcctaatacatgcatgtcgagcggagtttagagagcttgctttctaaacttagcggcaaatgggtgagtaacacgtaaggaacctgcctaagcgacgaggacaacggttggaaacgactgctaatactggatagtataagaaaccgcatgatttcttatttaaaggtccgtttggaccacgcttaga

SEQ ID NO: 871 - DNA, 225 bp, Unknown
  Encodes 16S rRNA from Acetanaerobacterium
agagtttgatcatggctcaggatgaacgctggcggcgcgcctaacacatgcaagtcgaacggacgaagctcttcggagccaagttagtggcgaacgggtgagtaacacgtgaggaacctgcctttcagagggggataacacttagaaataggtgctaataccgcataagaccacagagcggcatcgctcaggggtcaaaggagcaatccgctgaaagatggcctc

SEQ ID NO: 872 - DNA, 225 bp, Unknown
  Encodes 16S rRNA from Slackia
agagtttgatcatggctcaggatgaacgctggcggcgtgcctaacacatgcaagtcgaacgattaaagcccctccgggggtgcatagagtggcgaacgggtgagtaacacgtgaccaacccgccccggacaccgggacaacgggcggaaacgcctgctaataccggatactccgcgacggacgcatgtccgacgcgggaaagcccaggcggtccgggatggggtc

SEQ ID NO: 873 - DNA, 225 bp, Unknown
  Encodes 16S rRNA from Lachnospiracea incertae sedis
agagtttgatcctggctcaggatgaacgctggcggcgtgcctaacacatgcaagtcgagcggagataagcaccggatgaagatttatcggattccaccgcttatcttagcggcggatgggtgagtaacgcgtggataacctgccccttgcagggggataacaaccggaaacgggtgctaataccgcataggcgcgtaggaccgcatggtcctaagcgtaaagatt

SEQ ID NO: 874 - DNA, 225 bp, Unknown
  Encodes 16S rRNA from Oscillibacter
agagtttgatcctggctcaggacaaacgctggcggcgtgcctaacacatgcaagtcgaacggagcttatcaccttcgggaggtaagcttagtggcggactggtgagtaacgcgtgagcaacctgcccttcagtgggggacaacagctggaaacggctgctaataccgcatgacgttagatgaaggcatcttcgtttaactaaagatttattgctgaaggatgggc

SEQ ID NO: 875 - DNA, 225 bp, Unknown
  Encodes 16S rRNA from Prevotella
agagtttgatcatggctcaggatgaacgctagcgacaggcctaacacatgcaagtcgaggggcagcatggtcttagcttgctaagactgatggcgaccggcgcacgggtgagtaacgcgtatgcaacctttccgcgtccccgggacagtcggccgaaaggccgcgtaacaccgggcgttccgtttgaggggcatcccttgggcggaatacgcgagggtcgcgggt

SEQ ID NO: 876 - DNA, 225 bp, Unknown
  Encodes 16S rRNA from Proteiniphilum
agagtttgatcatggctcaggatgaacgctagcggcaggcctaacacatgcaagtcgaggggcagcgggaggtagcaataccttgccggcgaccggcgcacgggtgcgtaacgcgtatgcaacctaccttcaacagggggataacccagagaaatccggactaataccccgtatagtagcgagaccgcatgatcttgctacgaaagcttcggtggttggagatgg

SEQ ID NO: 877 - DNA, 225 bp, Unknown
  Encodes 16S rRNA from Spirochaeta
agagtttgatcatggctcagaacgaacgctggcggcgcgtcttaagcatgcaagtcgagcgggaaacagtagcttgctactgttgagagcggcggactggtgagtaacgcgtgggtgacgtaccctctggatggggatagctcctagaaataggaggtaataccgaatacgatgcacgggaacagaggccgtgcatgaaagtatcttttgatacgccggaggagc

SEQ ID NO: 878 - DNA, 225 bp, Unknown
  Encodes 16S rRNA from Ruminococcus
agagtttgatcatggctcaggacgaacgctggcggcacgcctaacacatgcaagtcgaacggtgaatgaatagcttgctagacattcatagtggcggacgggtgagtaacacgtgagcaacctgcctctgagagagggatagcttctggaaacggatggtaatacctcatgatatagcgttctcgcatgggaatgctatcaaacgaaattcgctcagagatgggc

SEQ ID NO: 879 - DNA, 225 bp, Unknown
  Encodes 16S rRNA from Prevotella
agagtttgatcctggctcaggatgaacgctagctacaggcttaacacatgcaagtcgaggggcatcgggagggaagcttgctttccttgccggcgaccggcgcacgggtgagtaacgcgtatccaacctgccgcacagtaggggatagcccggagaaatccggattaataccctatgttctccgagtcagtcatctgaattggagcaaaggttcgccgctgtgcg

SEQ ID NO: 880 - DNA, 225 bp, Unknown
  Encodes 16S rRNA from Butyricicoccus
agagtttgatcctggctcaggataaacgctggcggcgcacataagacatgcaagtcgaacgggaactttattgaagtttactgatataaagttctagtggcggactggtgagtaatgtataagcaacctgcctataagaggggaataacagtgagaaatcattgctaataccgcataagctgtgagaatggcatcattcaaacagaaaaggaagcaattccgctt

SEQ ID NO: 881 - DNA, 225 bp, Unknown
  Encodes 16S rRNA from Devosia
agagtttgatcatggctcagaacgaacgctggcggcaggcttaacacatgcaagtcaagggggtgtagcaatacacaaccggcgcacgggtgagtaacgcgtgggaatatgtccatttgtggggaatagcttctggaaacggaaggtaataccgcatacgccctacgggggaaagatttatcgcagatggagtggcccgcgttggattagctagttggttgggta

SEQ ID NO: 882 - DNA, 225 bp, Unknown
  Encodes 16S rRNA from Anaeroplasma
agagtttgatcatggctcaggattaacgctggcggcgtgcctaatacatgcaagtcggatggttagcttgctaaccatggcgaacgggtgagtaacacgtaggtaacctgtcttaaagacgaggataaccattggaaacgatggataatactggataggatatataagggcatcctgatatatttaaagatttatcactttatgaggggcctgcggcgcattagt

SEQ ID NO: 883 - DNA, 225 bp, Unknown
  Encodes 16S rRNA from Oscillibacter
agagtttgatcatggctcaggacgaacgctggcggcgtgcctaacacatgcaagtcgaacgaagctccgaaagcaacggtttcggccggagtggacggatgacttagtggcggacgggtgagtaacgcgtgagcaacctgcccttcagagggggacaacagttggaaacgactgctaataccgcataacgtaaggaaatggcatcatattcttaccaaagattta

SEQ ID NO: 884 - DNA, 225 bp, Unknown
  Encodes 16S rRNA from Barnesiella
agagtttgatcatggctcaggatgaacgctagcgacaggcctaacacatgcaagtcgagggtgaagtttgaagtagcttgctacggataatggaaaccggcgcacgggtgcgtaacaggtatgcaatctatcctaagccgggggatagcccactgaaaagtggattaatactccatgtgccacgagggggcatccttttgtggtgaaacgtgagggcataggttg

SEQ ID NO: 885 - DNA, 225 bp, Unknown
  Encodes 16S rRNA from Atopobium
agagtttgatcatggctcaggatgaacgctggcggcgcgcttaacacatgcaagtcgaacggttaaagcccttcggggtgaataaagtggcgaacggctgagtaacacgtgggcaacctacccctcacattgggatagcctcgggaaaccgggagtaataccgaatactccggacatctcgcatgggatgaccgggaaagctccggcggtgagggatgggcccgc

SEQ ID NO: 886 - DNA, 225 bp, Unknown
  Encodes 16S rRNA from Clostridium XlVa
agagtttgatcatggctcaggatgaacgctggcggcgcgcataacacatgcaagtcgaacggagtcacattgaaacctagtgatttgtgacttagtggcggacgggtgagtaacgcgtgggtaacctgcctggtattgggggacaacagttagaaatgactgctaataccgcatacgacgtcggggaggcatctccctgacgggaaaggaattatccgatatcag

SEQ ID NO: 887 - DNA, 225 bp, Unknown
  Encodes 16S rRNA from Methanobrevibacter
agagtttgatcctggcagatgctactgctattgggattcgattaagccatgcaagtcgaacgagtttaggctcgtggcgtacggctcagtaacacgtggataacctacccttaggactgggataaccctgggaaactggggataataccggataggcaatttttcctgtaatggttttttgtttaaatgttttttcgcctaaggatgggtctgcggccgattagg

SEQ ID NO: 888 - DNA, 225 bp, Unknown
  Encodes 16S rRNA from Butyricimonas
agagtttgatcatggctcaggatgaacgctagcggcaggcttaacacatgcaagtcgaggggcagcgcgtcgtagcaatacgatggcggcgaccggcggaagggtgcgtaacgcgtgagcaacttgcccgtcactgtgggataggcactggaaacggtgtgtaataccacgtaacactacgagctgcatggtttgtagttgaaagattcattggtgacggatagg

SEQ ID NO: 889 - DNA, 225 bp, Unknown
  Encodes 16S rRNA from Butyricimonas
agagtttgatcctggctcaggatgaacgctagcggcaggcttaacacatgcaagtcgaggggcagcgcgttgtagcaatacgatggcggcgaccggcgcaagggtgcgtaacgcgtgagcaacatgcccgcaacagggggataaccggaggaaactccgactaataccccataaggacgtaggacggcatcgtccagcatctaaacttacgagggttgcggattg

SEQ ID NO: 890 - DNA, 225 bp, Unknown
  Encodes 16S rRNA from Asaccharobacter
agagtttgatcatggctcaggatgaacgctggcggcgtgcctaacacatgcaagtcgaacggttaaaccggcttcggccggatatagagtggcgaacgggtgagtaacacgtgaccaacctgccccccgctccgggataacccagggaaacctgcgctaataccggatactccgcccgggccgcatggcccgggcgggaaagcccagacggcgggggatggggtc

SEQ ID NO: 891 - DNA, 225 bp, Unknown
  Encodes 16S rRNA from Enhydrobacter
agagtttgatcatggctcagattgaacgctggcggcaggcttaacacatgcaagtcgaacgatgaaactctagcttgctagagatgattagtggcggacgggtgagtaacatttaggaatctgcctagtagtgggggatagctcggggaaactcgaattaataccgcatacgacctacgggtgaaagggggcgcaagctcttgctattagatgagcctaaatcag

SEQ ID NO: 892 - DNA, 225 bp, Unknown
  Encodes 16S rRNA from Treponema
agagtttgatcatggctcagaatgaacgctggcggcgggtcttaagcatgcaagtcggacggcaagaaagtgcttgcactttcctagagtggcggactggtgaggaacacgttggtgacgtaccctttggatggggatagccggtagaaataccgggtaataccgaataaggtcggtggtcttggaagccaccgaggaaagcggctttggccgcgccgaaggaac

SEQ ID NO: 893 - DNA, 225 bp, Unknown
  Encodes 16S rRNA from Clostridium XlVa
agagtttgatcatggctcaggatgaacgctggcggcgtgcttaacacatgcaagtcgaacgaagcatgagtgatgagtaatctgatctcatgacttagtggcggacgggtgagtaacgcgtgggtaacctacctcacacagggggataacagttggaaacgactgctaaaaccgcataacatggcgataccgcatgacattgccatcaaatatttataggtgtga

SEQ ID NO: 894 - DNA, 225 bp, Unknown
  Encodes 16S rRNA from Adlercreutzia
agagtttgatcctggctcaggatgaacgctggcggcgtgcttaacacatgcaagtcgaacgattaacccatcttcggatggttataaagtggcgaacgggtgagtaacacgtgaccaacctgcctttcacattgggataactaagggaaactgtagctaataccaaatactccggcacctccgcatggtagtgccgggaaagctccggcggtgaaagatggggtc

SEQ ID NO: 895 - DNA, 225 bp, Unknown
  Encodes 16S rRNA from Prevotella
agagtttgatcctggctcaggatgaacgctagctacaggcttaacacatgcaagtcgcggggcagcgggagagaagcttgcttttcttgccggcgaccggcgcacgggtgcgtaacgcgtatcgaacctgccccagtcagggggacagccctctgaaaggaggattaataccccatggttccctgtgtccgcatggacgttgggataaaggagagattcggactg

SEQ ID NO: 896 - DNA, 225 bp, Unknown
  Encodes 16S rRNA from Pseudoflavonifractor
agagtttgatcatggctcaggatgaacgctggcggcgcgcctaacacatgcaagtcgaacggtgaagtcccttcgggggctgatcagtggcggacgggtgagtaacgcgtgaggaacctgcccttatgagcggaataacgtcgggaaactgacgctaataccgcataatgcatcaccggggcatcgcggtgatgccaaagcttcggcgcataaggatggactcgc

SEQ ID NO: 897 - DNA, 225 bp, Unknown
  Encodes 16S rRNA from Syntrophococcus
agagtttgatcatggctcaggatgaacgctggcggcgtgcttaacacatgcaagtcgaacgagaaccttacgacggagacttcggttgaagatgtaagaattctagtggcggacgggtgagtaacgcgtgggtaacctgcccatgagaggaggataacagggagaaattcttgctaatactctatatgcttacggtatcgcatgatactgtgaggaaatgaattt

SEQ ID NO: 898 - DNA, 225 bp, Unknown
  Encodes 16S rRNA from Clostridium IV
agagtttgatcatggctcaggatgaacgctggcggcgtgcctaacacatgcaagtcgaacgaagctcctgatttgatcccctcggggtaatttgacggatgacttagtggcggacgggtgagtaacgcgtgagcaacctgcctttcagagggggataacggttggaaacgaccgctaataccgcataacacagaggaaccgcatgattcttttgtcaaagctgag

SEQ ID NO: 899 - DNA, 225 bp, Unknown
  Encodes 16S rRNA from Demequina
agagtttgatcatggctcaggacgaacgctggcggcgtgcttaacacatgcaagtcgaacggtgaacctggagcttgctccgggggatcagtggcgaacgggtgagtaacacgtgagtaacctgccccagacactgggataacctcgggaaaccggggctaataccggatacgagacgctcgggcatccgaagcgtctggaaagatttatcggtctgggatggac

SEQ ID NO: 900 - DNA, 225 bp, Unknown
  Encodes 16S rRNA from Lachnospiracea incertae sedis
agagtttgatcctggctcaggatgaacgctggcggcgtgcttaacacatgcaagtcgaacggaacatttcgcccgatgattgaagtagcttgctacggattgaatcaactgaaatgtttagtggcggacgggtgagtaacgcgtgggtaacctaccttacacagggggataacagttagaaatgactgctaataccgcataagcgcacagtaccgcatggtacgg

SEQ ID NO: 901 - DNA, 225 bp, Unknown
  Encodes 16S rRNA from Saccharofermentans
agagtttgatcatggctcaggatgaacgctggcggtatgcttaacacatgcaagtcgaacggtagcagcaatgctatagtggcggacgggtgagtaacgcgtgaacaatctgcctgtatcaggggaataacagttcgaaaggactgctaataccgcatatgatcatagaggggcatccctcagtgatgaaagatttatcggatacagatgagttcgcgtcctatt

SEQ ID NO: 902 - DNA, 225 bp, Unknown
  Encodes 16S rRNA from Sphaerisporangium
agagtttgatcatggctcaggacgaacgctggcggcgtgcttaacacatgcaagtcgagcggaaaggcccttcggggtactcgagcggcgaacgggtgagtaacacgtgagcaacctgtccttgactctgggataagcctgggaaaccgggtctaataccggataggacctgtctccgcatgggggtgggtggaaagttttttcggtcaggggtgggctcgcggc

SEQ ID NO: 903 - DNA, 225 bp, Unknown
  Encodes 16S rRNA from Anaeroplasma
agagtttgatcatggctcaggattaacgctggcggcgtgcctaatacatgcaagtcgaatggttagcttgctaaccatggcgaacgggtgagtaacacgtaggcaacctgtctaagagacgaggataaccattggaaacgatggataatactggataagatattgggaggcatcttctgatatttaaagatttatcgctaatagaggggcctgcggcgcattagc

SEQ ID NO: 904 - DNA, 225 bp, Unknown
  Encodes 16S rRNA from Geobacillus
agagtttgatcctggctcagaatgaacgctggcggcatggattaggcatgcaagtcggacggggtgcagcgatgcacccagtggcgaaagggtgcgcaacgcgtggggaacctgcccccggatccgggacaagcgctggaaacggcgtctgatacgggatgcggaggggggccgcatggcccccgctccaaagattcatcgtccggggagggccccgcgtcccat

SEQ ID NO: 905 - DNA, 225 bp, Unknown
  Encodes 16S rRNA from Prevotella
agagtttgatcatggctcaggatgaacgctagctacaggcctaacacatgcaagtcgaggggcagcatgggagaagcttgcttttcccgatggcgaccggcgaatgggtgagtcacgcgtgtccaacctgccttcagcccggggatagcccttggaaatgaggattaagacccgatagatggaagttccgcatggcgcttccatgaaactggactgaagatgggg

SEQ ID NO: 906 - DNA, 225 bp, Unknown
  Encodes 16S rRNA from Clostridium XlVa
agagtttgatcctggctcaggatgaacgctggcggcgtgcctaacacatgcaagtcgaacgatgaagcggggaggaagttttcggatggaattcctgtggaagagtggcggacgggtgagtaacgcgtggataacctgccccgtacagggggatagcagcgggaaactgctggtaataccgtatatgcgcacaactgccgcatggcagggtgtggaaagttacgg

SEQ ID NO: 907 - DNA, 225 bp, Unknown
  Encodes 16S rRNA from Victivallis
agagtttgatcatggctcagaacgaacgctggcggcatggattaggcatgcaagtcgaacgaagcagcaatgcttagtggcgcaagggtgaggaacacgtgagtgacctacccgcaagtttggaacagctcctggaaacgggaattaataccggatgtgatcgataggccgcatggtttattgattaaagcagcaatgcgcttgcggatgggctcgcgtcccatt

SEQ ID NO: 908 - DNA, 225 bp, Unknown
  Encodes 16S rRNA from Bacteroides
agagtttgatcatggctcaggatgaacgctagctacaggcttaacacatgcaagtcgaggggcatcaggtatctagcttgctaggtatgctggcgaccggcgcacgggtgcgtaacacgtatccaacctgcccgcagctcagggacagcctttcgaaagaaagattaatacctgacggtctctaccggggacatccccggcagagtaaagattcatcggcggcgg

SEQ ID NO: 909 - DNA, 225 bp, Unknown
  Encodes 16S rRNA from Demequina
agagtttgatcctggctcaggacgaacgctggcggcgtgcttaacacatgcaagtcgaacggtgaactcggagcttgctccgggggatcagtggcgaacgggtgagtaacacgtgagtaacctgccccagactctgggataacctcgggaaaccggggctaataccggatacgagacgttcgggcatccgaagcgtctggaaagatttatcggtctgggatggac

SEQ ID NO: 910 - DNA, 225 bp, Unknown
  Encodes 16S rRNA from Paraeggerthella
agagtttgatcatggctcaggatgaacgctggcggcgtgcctaacacatgcaagtcgaacggttaagccggcttcggccgggaatacagtggcgaacgggtgagtaacacgtgaccaacctgccccccgccccgggatagccccccgaaagggggattaataccgggtactccgcaagggccgcatggcccctgcgggaaagctccggcggcgggggatggggtc

SEQ ID NO: 911 - DNA, 225 bp, Unknown
  Encodes 16S rRNA from Paraprevotella
agagtttgatcatggctcaggatgaacgctagcggcaggcttaacacatgcaagtcgaggggcagcgagagagtagcaatacttttgtcggcgaccggcgcacgggtgagtaacgcgtatgcaacctttcccagacagggggatagcccagggaaacttggattaataccccgtaggccgagggatggcatcgtccttcggttaaagttccggcggtctggggtg

SEQ ID NO: 912 - DNA, 225 bp, Unknown
  Encodes 16S rRNA from Pseudoflavonifractor
agagtttgatcatggctcaggacgaacgctggcggcgtgcttaacacatgcaagtcgaacgagggtattagtcagcttgctgattgatactcgagtggcggacgggtgagtaacgcgtgaggaacctgtcttcatcagggggataacgtcccgaaagggatgctaataccgcatgagaccacgataccgcatggtattgaggtcaaaggagcgatccggatgaag

SEQ ID NO: 913 - DNA, 225 bp, Unknown
  Encodes 16S rRNA from Roseburia
agagtttgatcctggctcaggatgaacgctggcggcgtgcttaacacatgcaagtcgaacggacttctccggaaataagcttcggcagaaagaaggaggagttagtggcggacgggtgagtaacgcgtgggcaacctgccttacattgggggataacagttagaaatgactgctaataccgcataagaccacgaggccgcatggccacggggtaaaagttccggc

SEQ ID NO: 914 - DNA, 225 bp, Unknown
  Encodes 16S rRNA from Gelidibacter
agagtttgatcatggctcaggataaacgctagcggcaggcctaacacatgcaagtcgagcggcagcgggagtggcaacacttgccggcgagcggcggacgggtgagtaacgcgtatgcaacctgcccaccacacggagatagccgaccgaaaggacgattaaactccgatggcacctcatcaaggcatcttcttgaggttaaatattcataggtggtggatgggc

SEQ ID NO: 915 - DNA, 225 bp, Unknown
  Encodes 16S rRNA from Clostridium IV
agagtttgatcctggctcaggacgaacgctggcggcgtgcctaacacatgcaagtcgaacggaactttaccggatgaagttttcggatggaatcagataaagtttagtggcggacgggtgagtaacgcgtgagtaacctgcccttcagagggggacaacgtcttgaaaaggacgctaataccgcataacatatattcatcgcatggtggatatatcaaaggagca

SEQ ID NO: 916 - DNA, 225 bp, Unknown
  Encodes 16S rRNA from Rhizobium
agagtttgatcatggctcagaacgaacgctggcggtatgcttaacacatgcaagtcgcacgagaaagttcttcggaatgagtaaagtggcgtacgggtgagtaatgtataggaatctacccagtaatgaggaataagcactggaaacggtgtctaataccacatactaccgatttatcgggaaaggtttaatcttcgggttaaactgttattggatgagcctata

SEQ ID NO: 917 - DNA, 225 bp, Unknown
  Encodes 16S rRNA from Acholeplasma
agagtttgatcatggctcaggatgaacgctggcggcgtgcctaatacatgcaagtcgaacggataccttcgggtattagtggcgaacgggtgagtaacacgtaggtaatctaccttaaagacggggataacagatggaaacgactgttaataccggatagtatatgaagtcgcatgattttatatttaaagttcccacgggaacactttaagatgagcctgcggc

SEQ ID NO: 918 - DNA, 225 bp, Unknown
  Encodes 16S rRNA from Clostridium XlVa
agagtttgatcctggctcaggatgaacgctggcggcgtgcctaacacatgcaagtcgaacggagatgcatcagcgagaggattcgtccgatcaagatgtatcttagtggcggacgggtgagtaacgcgtggataacctgcctccatccgggggatagcagttggaaacgactggtaataccgcatgagcgcacggtaaggcatcttacagtgtgaaaagattaat

SEQ ID NO: 919 - DNA, 225 bp, Unknown
  Encodes 16S rRNA from Bacteroides
agagtttgatcatggctcaggatgaacgctagcggcaggcttaacacatgcaagtcgaggggcagcgagagagtagcaatacttttgtcggcgaccggcgcacgggtgagtaacgcgtatgcaacctttcccagacagggggatagcccagggaaacttggattaataccccgtaggccgagtggcggcatcgccgttcggttaaagttccggcggtctggggtg

SEQ ID NO: 920 - DNA, 225 bp, Unknown
  Encodes 16S rRNA from Bacteroides
agagtttgatcctggctcaggatgaacgctagcggcaggcttaacacatgcaagtcgaggggcagcgtgggggtagcaatacttccgacggcgaccggcgcacgggtgagtaacgcgtatgcaacctttcccagacagggggatagcccagggaaacttggattaataccccgtaggccacaggcgggcatccgccagtggttaaagttccggcggtctggggtg

SEQ ID NO: 921 - DNA, 225 bp, Unknown
  Encodes 16S rRNA from Papillibacter
agagtttgatcatggctcaggatgaacgctggcggcgtgcataacacattcaagtcgaacgaagcactttggacggatcccttcggggtgaagactgatttgacttagtggcggacgggtgagtaacgcgtgagcaacctgccttgaagagggggataacacagggaaacttgtgctaataccgcataacgtacgtggatcgcatggtccgtgtaccaaagcctt

SEQ ID NO: 922 - DNA, 225 bp, Unknown
  Encodes 16S rRNA from Fusibacter
agagtttgatcctggctcaggattaacgctggcggcgtgcctaacacatgcaagtcgagcgggaaatttgagagcgaagcttcggcagagctcttaaatggagagcggcggacgggtgagtaacgcgtaggtaacctgccctgcacagagggatagccactggaaacggtgattaatacctcataaaactgttttgccgcatgacagaacagccaaagatttatc

SEQ ID NO: 923 - DNA, 225 bp, Unknown
  Encodes 16S rRNA from Coraliomargarita
agagtttgatcctggctcagagtgaacgctggcggcgtggctaagacatgcaagtcgagcgagaaggtgccttcgggtaccggaaagcggcaaacgggtgcgtaacacgtaagtaacctgcccttaagacgggaacagcttgatgaaaattaagataatgcccgatatccgcttctttcgcatgagagaagtcggaaaggtttgtgatgacgcttaaggaggggc

SEQ ID NO: 924 - DNA, 225 bp, Unknown
  Encodes 16S rRNA from Papillibacter
agagtttgatcatggctcaggattaacgctggcggcgtgcataacacattcaagtcgaacggagtgtagaaatacacttagtggcggacgggtgagtaacgcgtgagcaatctaccttccagtgcgggataacaaccggaaacagttgctaataccgcatgaaccggcagcatcgcatggtgcaaccggcaaaggcttgctgctggaagatgagcttgcgtccga

SEQ ID NO: 925 - DNA, 225 bp, Unknown
  Encodes 16S rRNA from Clostridium XlVa
agagtttgatcatggctcaggatgaacgctggcggcgtgcctaacacatgcaagtcgaacggagctgcgacgctgatgattggagtacttgtacgaagagaatcttgtcgtagcttagtggcggacgggtgagtaacgtgtggataacctggtccaatctgggggatagcagctggaaacggctggtaataccgcataagcgcacggtgtggcatcacacagtgt

SEQ ID NO: 926 - DNA, 225 bp, Unknown
  Encodes 16S rRNA from Acholeplasma
agagtttgatcatggctcaggatgaacgctggcggcgtgcctaatacatgcaagtcgaacgagctgcttcggcagcgagtggcgaacgggtgagtaacatatgaataatctacctctttaactgggataccagtctgaaaagactgctaataccggataggtaatactgaggcatctcggtattattaaagatgcgtttgcatcgaattgagatgagttcatatc

SEQ ID NO: 927 - DNA, 225 bp, Unknown
  Encodes 16S rRNA from Catenibacterium
agagtttgatcggccacattggaactgagacacggtccaaactcctacgggaggcagcagtaaggagttttcggcaatgggggaaaccctgaccgagcaacgccgcgtgagcgatgacggtcctttggattgtaaagctctgttgtaagccatgaaagatagctttaggaaatgaaagttatttgacgacagcttaccagaaagccacggctaactacgtgccag

SEQ ID NO: 928 - DNA, 225 bp, Unknown
  Encodes 16S rRNA from Clostridium IV
agagtttgatcatggctcaggatgaacgctggcggcgtgcttaacacatgcaagtcgaacgaggttagcggcttcggccgataaccgagtggcggacgggtgagtaacgcgtgaacaatctgtcctgcaaagggggataacaactggaaacagttgctaataccgcataagaccacgaagtcgcatggctttgaggtaaaagcagcgatgcgatgcagggtgagt

SEQ ID NO: 929 - DNA, 225 bp, Unknown
  Encodes 16S rRNA from Clostridium IV
agagtttgatcatggctcaggatgaacgctggcggcgtgcttaacacattcaagtcgaacggacgaggggagcttgctccccaagttagtggcggacgggtgagtaacgcgtgagcaacctgcctttctaagcgggataacagagggaaaccgctgctaataccgcataacgtatgatgaacgcatgttcgacataccaaaggagcgatccgaagaaagatgggc

SEQ ID NO: 930 - DNA, 225 bp, Unknown
  Encodes 16S rRNA from Clostridium IV
agagtttgatcatggctcaggacgaacgctggcggtatgcctaacacatgcaagtcgaacgggtgtgtagagagcttgctctttatttcactagtggcggacgggtgagtaacgcgtgagtaatctgccttgaagtgggggataacatttggaaacaagtgctaataccgcgtaatatacgttcttcgcatgaagtttgtatcatagtttttcgcttcaagatga

SEQ ID NO: 931 - DNA, 225 bp, Unknown
  Encodes 16S rRNA from Nitrobacter
agagtttgatcatggctcagagcgaacgctagcggaatgctttatacatgcaagtcgaacgaaaaaccatacggagtagcaatacaaagtggaagtttttagtggcgaacgggtgagtaatagataggaacttgccgagtagtgggggacaacagatagaaatgtctgctaataccgcatacgcccgagaggggaaagatttatcgctatttgagaggcctattc

SEQ ID NO: 932 - DNA, 225 bp, Unknown
  Encodes 16S rRNA from Victivallis
agagtttgatcatggctcagaacgaacgctggcggcatggattaggcatgcaagtcgaacgaagcagcaatgcttagtggcgcaagggtgaggaacacgtgagtgacctgcccgcaagtttggaacagctcctggaaacgggaattaataccggatgtgatcatagagctgcatggttttatgattaaagcagcaatgcgcttgcggatgggctcgcgtcccatt

SEQ ID NO: 933 - DNA, 225 bp, Unknown
  Encodes 16S rRNA from Selenomonas
agagtttgatcctggctcaggacgaacgctggcggcgtgcttaacacatgcaagtcgaacgagacgattgaaagcttgcttttgaaagtcgagtggcaaacgggtgagtaacgcgtagacaacctgcctttgagatggggacaacagtccgaaaggactgctaataccgaatgttgtggattttccgcatgggagatccaccaaagatgacctcttcctgaaagt

SEQ ID NO: 934 - DNA, 225 bp, Unknown
  Encodes 16S rRNA from Enterorhabdus
agagtttgatcatggctcaggatgaacgctggcggcgtgcctaacacatgcaagtcgaacggttaaagcgccttcgggcgtgcatagagtggcgaacgggtgagtagcacgtgaccaacctgccccgcgcaccgggacagcctcgcgaaagcgggattaataccggatactccggccgcaccgcatggtgcggccgggaaagctccggcggcgcgggatggggtc

SEQ ID NO: 935 - DNA, 225 bp, Unknown
  Encodes 16S rRNA from Eubacterium
agagtttgatcatggctcaggacgaacgctggcggtatgcttaacacatgcaagtcgaacgagaagcgggtattggaggtttcggccgaagagacctgcagaaagtggcgaacgggtgagtaacgcgtgggcaacctgcctcatggaaagggatagcctcgggaaactgggagtaaaaccttataacatatgcttatcgcatggtaggcatatcaaaactccggt

SEQ ID NO: 936 - DNA, 225 bp, Unknown
  Encodes 16S rRNA from Roseburia
agagtttgatcctggctcaggatgaacgctggcggcgtgcttaacacatgcaagtcgaacgaagcattttgatctgatcatttcggtgtgaagaacttaatgacttagtggcggacgggtgagtaacgcgtgggtaacctacctcatacagggggatagcagttggaaacgactgataataccgcataagcgcacaggaccgcatggtccagtgtgaaaagcctt

SEQ ID NO: 937 - DNA, 225 bp, Unknown
  Encodes 16S rRNA from Prevotella
agagtttgatcatggctcaggatgaacgctagctacaggcttaacacatgcaagtcgaggggcagcatggggactgcttgcagttcccgatggcgaccggcgcacgggtgagtaacgcgtatccaacctgcccgcaaccgcggaatagcccgccgaaaggcggattaatgccgcatgagctcgcgagagggcatctggccgcgagcaaaggtatttccggttgcg

SEQ ID NO: 938 - DNA, 225 bp, Unknown
  Encodes 16S rRNA from Asaccharobacter
agagtttgatcctggctcaggatgaacgctggcggcgtgcttaacacatgcaagtcgaacgagaaagcaccctcgggtgcgagtagagtggcgaacgggtgagtaacacgtgagcaacctgccccccgcaccgggataaccgggcgaaagcccggctaataccggatgcgccccggcgcgcgcatgcgcggcgggggaaagccctggcggcgggggatgggctcg

SEQ ID NO: 939 - DNA, 225 bp, Unknown
  Encodes 16S rRNA from Bacteroides
agagtttgatcatggctcaggatgaacgctagctacaggcttaacacatgcaagtcgaggggcagcatggtgtgtgcttgcacacactgatggcgaccggcgcacgggtgagtaacgcgtatccaacctgcccggtactcgggaacagccctctgaaaggaggattaatgcccgatgttccgtgcatcccgcctgggatgcccggcaaagattcatcggtaccgg

SEQ ID NO: 940 - DNA, 225 bp, Unknown
  Encodes 16S rRNA from Clostridium XlVa
agagtttgatcctggctcaggatgaacgctggcggcgtgcctaacacatgcaagtcgaacgaggtattgcaatcgagatggaggagcttgctccgaagtctcactcgtgataccgagtggcggacgggtgagtaacgcgtggagaacctgccccgtacagggggataccaattagaaatgattgttaataccgcataagcgcacatgaccgcatggtcgagtgtg

SEQ ID NO: 941 - DNA, 225 bp, Unknown
  Encodes 16S rRNA from Gelidibacter
agagtttgatcctggctcaggataaacgctagcggcaggcctaacacatgcaagtcgagcggcagcgggagtagcaatacttgccggcgagcggcggacgggtgagtaacgcgtatgcaacctgcccaccacacggagatagccgaccgaaaggacgattaaactccgatggcacctcatcaaggcatctttttgaggttaaatatttataggtggtggatgggc

SEQ ID NO: 942 - DNA, 225 bp, Unknown
  Encodes 16S rRNA from Brevundimonas
agagtttgatcatggctcaggacgaacgctggcggtgtgcctcatacatgcaagtcgaacgataaggttccttcgggaatacataagtggcggacgggtgagtacaacataggaaatctgccctaaactgggggacaacagagggaaactcctgctaataccccatatgagcttagttgaaatactaatcttgaaagctccggcggtttaggatgagcctgtgcc

SEQ ID NO: 943 - DNA, 225 bp, Unknown
  Encodes 16S rRNA from Clostridium XlVa
agagtttgatcctggctcaggatgaacgctggcggcgtgcctaacacatgcaagtcgaacgaagcgcccggaacagaggattcgtccgaagggaagggatgactgagtggcggacgggtgagtaacgcgtggaaaacctgccccatgcagggggacaacagggagaaatccctgctaataccgcataagcgcacggcacggcatcgtgcagtgtgaaaagattta

SEQ ID NO: 944 - DNA, 225 bp, Unknown
  Encodes 16S rRNA from Prevotella
agagtttgatcctggctcaggatgaacgctagctacaggcttaacacatgcaagtcggggggcagcacgggaagcagcaatgcttttgggtggcgaccggcgaatgggtgagtaacgagtatccaacctgccccgcgctccgggacagccccgcgaaagcgggattaataccggatgcggcatggttcccgcatgggctccatgtcaaagattcatcggcgcggg

SEQ ID NO: 945 - DNA, 225 bp, Unknown
  Encodes 16S rRNA from Oscillibacter
agagtttgatcatggctcaggatgaacgctggcggcgtgcctaacacatgcaagtcgaacgagaatcgatggaaagaggcttcggccaatggaagtcgaggacagtggcggacgggtgagtaacacgtgagcaacctgcccttcagagggggacaacagttggaaacgactgctaataccgcataacgtatcgaggaggcatctccatgataccaaagatttatc

SEQ ID NO: 946 - DNA, 225 bp, Unknown
  Encodes 16S rRNA from Asteroleplasma
agagtttgatcctggctcaggataaacgctggcggcgtgcctaatacatgcaagtcgaacgaggtgtagcaatacacctagtggcgtacgggtgagtaacacgttgggaacctgccctttagaccggaataccaagcggaaacgtttgctaatgccggataacagcacgtaagcgcaggcttatgtgctcaaaggcgactattgtcgcgcttaaggatggccctg

SEQ ID NO: 947 - DNA, 225 bp, Unknown
  Encodes 16S rRNA from Anaeroplasma
agagtttgatcctggctcaggataaacgctggcggcgtgcctaatacatgcaagttgaacggagagcttcggctcttagtagcgaacgggtgagtaacacgtaggcaacctgccctgttgactgggataacaagacgaaagacttgctaataccggatgataacgtatatcgcatgatatatggatgaaagttgggacacaacacaacaggatgggcctgcggcg

SEQ ID NO: 948 - DNA, 225 bp, Unknown
  Encodes 16S rRNA from Oscillibacter
agagtttgatcatggctcaggacgaacgctggcggcgtgcttaacacatgcaagtcgaacgaagctctcacgcttgagttttcggacaagagggtgagaagacttagtggcggactggtgagtaacgcgtgagcaacctgccctccggtgggggacaacagttggaaacgactgctaataccgcatgacgtatacggaccgcatgatctgtataccaaagcttaa

SEQ ID NO: 949 - DNA, 225 bp, Unknown
  Encodes 16S rRNA from Bilophila
agagtttgatcatggctcagattgaacgctggcggcgtgcttaacacatgcaagtcgaacgtgaaagtccttcgggacgagtaaagtggcgcacgggtgagtaacgcgtggataatctaccttcaagatggggataacggctggaaacggtcgctaataccgaatacgcttttttatttatctttaaaaggaaagatggcctctgcttgcaagctatcgcttgaa

SEQ ID NO: 950 - DNA, 225 bp, Unknown
  Encodes 16S rRNA from Oscillibacter
agagtttgatcatggctcaggacgaacgctggcggcgtgcctaacacatgcaagtcgaacgaagctccgagaaacaagacttcggtcaagcggaacggatgactgagtggcgaacgggtgagtaacgcgtgaggaacctgcctttcagtgggggacaacagttggaaacgactgctaataccgcatgatgtaccatgggggcatccccggggtaccaaagattta

SEQ ID NO: 951 - DNA, 225 bp, Unknown
  Encodes 16S rRNA from Clostridium IV
agagtttgatcctggctcaggacgaacgctggcggcgtgcttaacacatgcaagtcgaacgaagttccgcggaatgagatttcggtcaaaagaagcggacacttagtggcggacgggtgagtaacgcgtgagtaacctgcctttcagaggggaataacatttggaaacgaatggtaataccgcataacatcaagttatcgcatgatagattgatcaaaggagcaa

SEQ ID NO: 952 - DNA, 225 bp, Unknown
  Encodes 16S rRNA from Prevotella
agagtttgatcctggctcaggatgaacgctagctacaggcttaacacatgcaagtcgaggggcagcgagggggcagcaatgcccctgtcggcgaccggcgcacgggtgagtaacgcgtatccaacctgccccatggtagggaatagcccggagaaatccggattaatgccctatgttctccgacgatggcatctgacttggagcaaagatttatcgccatgggat

SEQ ID NO: 953 - DNA, 225 bp, Unknown
  Encodes 16S rRNA from Geosporobacter
agagtttgatcatggctcaggatgaacgctggcggcgtgcctaacacatgcaagtcgagcgggaaatctccaattgaaggttcgctggaaagcggagatggatagcggcggacgggtgagtaacgcgtaggtaagctgccctatgcacagggatagcctagggaaacctggattaatacctgatgacgctgcgaggtcacatggccatgcagccaaagttttttc

SEQ ID NO: 954 - DNA, 225 bp, Unknown
  Encodes 16S rRNA from Butyricimonas
agagtttgatcatggctcaggatgaacgctagcggcaggcttaacacatgcaagtcgaggggcagcgcgtcgtagcaatacgatggcggcgaccggcgcaagggtgcgtaacgcgtgagcaacatgcccgcaacagggggataaccggaggaaactccgactaataccccataaggatgtagagtggcatcattcagcatctaaacttacgagggttgcggattg

SEQ ID NO: 955 - DNA, 225 bp, Unknown
  Encodes 16S rRNA from Pseudoflavonifractor
agagtttgatcatggctcaggacgaacgctggcggcgtgcttaacacatgcaagtcgaacgagggtgaatgggagcttgcttctgttcacccgagtggcggacgggtgagtaacgcgtgaggaacctgtcttcatcagggggataacttcccgaaagggatgctaataccgcataagaccacggtaccgcatggtattgaggtcaaaggagcgatccggatgaag

SEQ ID NO: 956 - DNA, 225 bp, Unknown
  Encodes 16S rRNA from Barnesiella
agagtttgatcatggctcaggatgaacgctagcgacaggcctaacacatgcaagtcgaggggcagcgagtttgtagcaatacagatgtcggcgaccggcgcacgggtgcgtaacaggtgtgcaacctggcctataccaagggatagcccgctgaaaggcggattaagactttatatgttatggtgagacatctcattataatgaaacgtgagggtataggatggg

SEQ ID NO: 957 - DNA, 225 bp, Unknown
  Encodes 16S rRNA from Selenomonas
agagtttgatcctggctcaggacgaacgctggcggcgtgcttaacacatgcaagtcgaacgagacgattgaaagcttgcttttgaaagtcgagtggcaaacgggtgagtaacgcgtaggcaacctaccttcgagatggggacaacagtccgaaaggactgctaataccgaatgttgtatcaattccgcatggagttggtattaaagatggcctctatttataagc

SEQ ID NO: 958 - DNA, 225 bp, Unknown
  Encodes 16S rRNA from Prevotella
agagtttgatcctggctcaggatgaacgctagcggcaggcttaacacatgcaagtcgaggggcagcgagaggtagcaatactttgtcggcgaccggcgaaagggtgagtaacgcgtgagcgacgtgcccgtcacagggggacaagggctggaaacggcttctgataccccataggaatgtatgcttcatggtgtatgtttgaaagatttatcggtgacggatcgg

SEQ ID NO: 959 - DNA, 225 bp, Unknown
  Encodes 16S rRNA from Enterorhabdus
agagtttgatcatggctcaggatgaacgctggcggcgtgcctaacacatgcaagtcgaacggttaagccggcttcggccgggtatagagtggcgaacgggtgagtaacacgtgaccaacctgccccgcgctccgggatagccccgcgaaagcgagattaataccggatgacgcgggaggggcgcatgcccctcccgccaaagcctcaacggcgcgggatggggtc

SEQ ID NO: 960 - DNA, 225 bp, Unknown
  Encodes 16S rRNA from Oscillibacter
agagtttgatcatggctcaggacgaacgctggcggcgtgcctaacacatgcaagtcgaacgagaatcatatgacggaggcttcggccaactgagtatgaggaaagtggcgaacgggtgagtaacgcgtgaggaacctgcctcggagtgggggacaacagttggaaacgactgctaataccgcataatgtgcctggaaggcatcttccgggtaccaaagctttatg

SEQ ID NO: 961 - DNA, 225 bp, Unknown
  Encodes 16S rRNA from Pelotomaculum
agagtttgatcatggctcaggacaaacgctggcggcgtgcttaacacatgcaagtcgtacggagctgtcaggcggaatccttcgggaggaagcctgagagcttagtggcggacgggtgagtaacgcgtgagcaacctgcccataagagggggataacagttggaaacgactgctaataccgcatgagaccacaacaccgcatggtggaggggtcaaagagcaatc

SEQ ID NO: 962 - DNA, 225 bp, Unknown
  Encodes 16S rRNA from Cellulosilyticum
agagtttgatcatggctcaggataaacgctggcggcgcacataagacatgcaagtcgaacgagtttaatacctagcttgctaggtaagcgactagtggcggactggtgagtaacacgtaaggaacctgcctattagagaggaatacctttgagaaatcagagctaatacctcatatgccttaactactgcatggtagaagagggaaaggagcaatccgctaatag

SEQ ID NO: 963 - DNA, 225 bp, Unknown
  Encodes 16S rRNA from Clostridium IV
agagtttgatcatggctcaggacgaacgctggcggcgtgcttaacacatgcaagtcgaacgagaatccgtggaaagagttttcggacaatggaagcggagggaagtggcggacgggtgagtaacgcgtgaggaacctgccttagagagggggacaacagctggaaacggctgctaataccgcatgacacacagtggaggcatctttactgtgtcaaagatttatc

SEQ ID NO: 964 - DNA, 225 bp, Unknown
  Encodes 16S rRNA from Parabacteroides
agagtttgatcatggctcaggatgaacgctagcgacaggcttaacacatgcaagtcgaggggcagcgggggcgatggcaacattgcctgccggcgaccggcgcactggtgagtaacacgtatgcaacctgccccgcacagggggataacccagagaaatttggcctaataccccgtaacaccgttgggggcatccccggtggttgaaagaggcgactcggtgcgg

SEQ ID NO: 965 - DNA, 225 bp, Unknown
  Encodes 16S rRNA from Papillibacter
agagtttgatcctggctcaggataaacgctggcggcgcacataagacatgcaagtcgaacgaacttaattacttgcttgcaagtaaagcggttagtggcggactggtgagtaacacgtaagaaatctgcctattagtggggaataacagtgagaaatcattgctaataccgcatatgccataagaatcgcatgattctagtgggaaaggagcaattcgctaatag

SEQ ID NO: 966 - DNA, 225 bp, Unknown
  Encodes 16S rRNA from Bacteroides
agagtttgatcctggctcaggatgaacgctagctacaggcttaacacatgcaagtcgcggggcatcgcggtaagtagcaatactttctggcggcgaccggcggatgggtgagtaacgcgtatccaacctggccctatctcggggacagcccctcgaaagagggattaatacccgatgttccctggaattcgcatgttttccagtgcaaaggcatatgtcggatag

SEQ ID NO: 967 - DNA, 225 bp, Unknown
  Encodes 16S rRNA from Prevotella
agagtttgatcatggctcaggatgaacgctagctacaggcttaacacatgcaagtcgaggggcatcatgcaggttgcttgcaacctgtgatggcgaccggcgcacgggtgcgtaacgcgtatccaaccttccccgcagtagggtccagcccgttgaaagacggattaatcccctatgttgtccattgacggcatccgatttggacgaaagatttgatcgctgcgg

SEQ ID NO: 968 - DNA, 225 bp, Unknown
  Encodes 16S rRNA from Hydrogenoanaerobacterium
agagtttgatcatggctcaggagaaacgctggcggcgcacataagacatgcaagtcgaacggaatttagtcgaatgtttacatgagacgaaaatttagtggcggacgggtgagtaacacgtgagcaacctgcctttaggagggggataacattgagaaatcagtgctaataccgcataacgcataatgttcgcatgaacgatatgccaaaggagaaatccaccta

SEQ ID NO: 969 - DNA, 225 bp, Unknown
  Encodes 16S rRNA from Clostridium XlVa
agagtttgatcctggctcaggatgaacgctggcggcgtgcctaacacatgcaagtcgaacggaggtgtccgtacgggtgcttcggcatccagggcaccttagtggcggacgggtgagtaacgcgtggagaacctggcccatgcagggggataacagcgggaaaccgctgctaataccgcataaacgcgaaagggggcatcccttttggcggaaagtgtaagcggc

SEQ ID NO: 970 - DNA, 204 bp, Unknown
  Encodes 16S rRNA from Prevotella
agagtttgatcatggctcaggatgaacgctagctacaggctttggtcaatgggcgaaagcctgaaccagccaagtagcgtgcaggatgacggccctatgggttgtaaactgtttttatacggggataaaacgagggacgtgtccctccttgcaggtaccgtatgaataaggaccggctaattccgtgccagcagccgcggtaat

SEQ ID NO: 971 - DNA, 225 bp, Unknown
  Encodes 16S rRNA from Clostridium IV
agagtttgatcctggctcaggacgaacgctggcggcgcgcctaacacatgcaagtcgaacggagagtgggttttgattctttcgggatgaaaagctcatttcttagtggcggacgggtgagtaacacgtgagcaacctgccttgcagagcgggataacggttggaaacgatcgctaataccgcataatatatgattgtcgcatggctttcatatcaaagatttat

SEQ ID NO: 972 - DNA, 225 bp, Unknown
  Encodes 16S rRNA from Howardella
agagtttgatcctggctcaggataaacgctggcggcgcacataagacatgcaagtcgaacggaagtcgtaattaaaaaggaacaaagatttatcggagtgagattttaattacaatggctttagtggcggactggtgagtaatgtataagtaacctgcctattagaggggaacaacagttggaaacagctgctaataccgcatatgccataagaatcgcatggtt

SEQ ID NO: 973 - DNA, 225 bp, Unknown
  Encodes 16S rRNA from Slackia
agagtttgatcatggctcaggatgaacgctggcggcgtgcctaacacatgcaagtcgaacggttaaggcatcttcggatgcgaataaagtggcgaacgggtgagtaacacgtgaccaacctgccccccgcaccgggacaacgggcggaaacgcctgctaataccggatactccgcgacggacgcctgtccggcgcgggaaagcccaggcggcgggggatggggtc

SEQ ID NO: 974 - DNA, 225 bp, Unknown
  Encodes 16S rRNA from Methylobacter
agagtttgatcatggctcagaatgaacgctggcggtatgcttaatacatgcaagtcgaacgagaaagtccagcaatggatgagtaaagtggcgtacgggtgagtaatatataggaatctacccagtaatgaggaataagcactggaaacggtgtctaataccacatactaccatttatttgggaaagggttagtagcaatactaacttgttattggatgagccta

SEQ ID NO: 975 - DNA, 225 bp, Unknown
  Encodes 16S rRNA from Treponema
agagtttgatcctggctcagaacgaacgctggcggcgcgtcttaagcatgcaagtcgggcgggatcgtggtgcttgcaccacgtgagagcggcggactggcgaggagcgcgtgggtgacgcaccccccggacggggacagccggcagaaatgccgggtgataccggatgaggtcccccttgttggaggagggggaggaaaggggcttcggccccgccgggggagc

SEQ ID NO: 976 - DNA, 187 bp, Unknown
  Encodes 16S rRNA from Clostridium XlVa
agagtttgatcctggctcaggataaacgctggcggcgtgcttaattggacaatgggggcaaccctgatccagcgacgccgcgtgagcgatgaagtatctcggtatgtaaagctctatcagcagggaagataatgacggtacctgactaagaagcaccggctaaatacgtgccagcagccgcggtaat

SEQ ID NO: 977 - DNA, 225 bp, Unknown
  Encodes 16S rRNA from Devosia
agagtttgatcatggctcagaacgaacgctgtcgacatgcttaacacatgcaagtcgtacgggtataacttgttataccagtggcaaacgggtgagtaatacgtagatatgtacccagtagtctcgaataacagttggaaacgattgataatacgagatactatggtaacatcaaaggtttagcaataaactgctattggagcagtctacggtggattagatagt

SEQ ID NO: 978 - DNA, 225 bp, Unknown
  Encodes 16S rRNA from Ruminococcus
agagtttgatcatggctcaggacgaacgctggcggcacgcttaacacatgcaagtcgaacggagatattcccttcgggggataacttagtggcggacgggtgagtaacacgtgagcaacctgccttacagagaggaataatgactggaaacggtcactaatacctcataaaatatttgaatcgcatggttcggatatcaaagatttatcgctgtaagatgggctc

SEQ ID NO: 979 - DNA, 225 bp, Unknown
  Encodes 16S rRNA from Lachnospiracea incertae sedis
agagtttgatcctggctcaggatgaacgctggcggcgtgcctaacacatgcaagtcgaacgaagcacccctcccgaagattgacgtagcttgctacagattgattcaattggggtgacttagtggcggacgggtgagtaacgcgtgggtaacctgccctatagagggggacaacagttggaaacgactgctaataccgcataacacatttgcaccgcatgatgcg

SEQ ID NO: 980 - DNA, 225 bp, Unknown
  Encodes 16S rRNA from Clostridium III
agagtttgatcatggctcaggacgaacgctggcggcgtgcctaacacatgcaagtcgaacggagttgttttggatgatgccttcgggtggattccgattcaacttagtggcggacgggcgagtaacgcgtgaataacctgcccataagaggggaataatccatggaaacgtggactaataccgcatattgtaacgaagtcgcatggctttgttatgaaagattta

SEQ ID NO: 981 - DNA, 225 bp, Unknown
  Encodes 16S rRNA from Methanobrevibacter
agagtttgatcatggcagatgctactgctattgggattcgattaagccatgcaagtcgaacgagtttaggctcgtggcgtacggctcagtaacacgtggataacctacccttaggactgggataaccctgggaaactggggataatactagataggcaatttttcctggaatggttttttgtttaaatgttttttcgcctaaggatgggtctgcggccgattagg

SEQ ID NO: 982 - DNA, 225 bp, Unknown
  Encodes 16S rRNA from Paraprevotella
agagtttgatcatggctcaggatgaacgctagcggcaggcttaacacatgcaagtcgaggggcagcgagtcggtagcaatactgatgtcggcgaccggcgcacgggtgagtaacgcgtatgcaacctttcccagacagggggatagcccagggaaacttggattaataccccgtaggccatggatgggcatccatctatggttaaagttccggcggtctggggtg

SEQ ID NO: 983 - DNA, 225 bp, Unknown
  Encodes 16S rRNA from Desulfobulbus
agagtttgatcctggctcagaacgaacgctggcggcgtgcttaacacatgcaagtcgaacgcgaaagcggcttcggtcgtgagtagagtggcgcacgggtgagtaacgcgtagataacctgtcttcatattcgggataacacgccgaaaggggtactaataccggatatactcgcatttcaataggtgaggcgaggaaaggtggcctctgattcaagctactgta

SEQ ID NO: 984 - DNA, 225 bp, Unknown
  Encodes 16S rRNA from Butyricicoccus
agagtttgatcctggctcaggacgaacgctggcggcgtgcctaacacatgcaagtcgaacggaactattttgaaggatctcttcggagtgacggatttttagtttagtggcgatcggtagccggactgagaggttgatcggccacattgggactgagacacggcccagactcctacgggaggcagcagtgggggatattgcgcaatgggggcaaccctgacgcag

SEQ ID NO: 985 - DNA, 225 bp, Unknown
  Encodes 16S rRNA from Clostridium XlVa
agagtttgatcctggctcaggatgaacgctggcggcgtgcctaacacatgcaagtcgagcggagatgcacattggatgaagattcgtccgaatcctggtgcatcttagcggcggatgggtgagtaacgcgtggacaacctgcccgcaacagggggataacagctggaaacggctgataataccgcatatgcacacggaaccgcatggttttgggtggaaagatta

SEQ ID NO: 986 - DNA, 225 bp, Unknown
  Encodes 16S rRNA from Dialister
agagtttgatcctggctcaggacgaacgctggcggcgtgcttaacacatgcaagtcgaacgggaggaaaagagaagcttgcttctttttgaatctagtggcaaacgggtgagtaacacgtaaacaacctgccttcaggatggggacaacagacggaaacgactgctaataccgaatgtgttccggagaccgcatgatttccggaagaaaggatggcctctattta

SEQ ID NO: 987 - DNA, 225 bp, Unknown
  Encodes 16S rRNA from Selenomonas
agagtttgatcatggctcaggacgaacgctggcggcgtgcttaacacatgcaagtcgaacgagacgattttaagcttgcttagatgagtcgagtggcaaacgggtgagtaacgcgtagacaacctgccgcaaagatggggacaacagtccgaaaggactgctaataccgaatgttgtatcgtttccgcatggagatgatattaaagatggcctctacttgtaagc

SEQ ID NO: 988 - DNA, 225 bp, Unknown
  Encodes 16S rRNA from Spirochaeta
agagtttgatcctggctcagaacgaacgctggcggcgcgtcttaagcatgcaagtcgagcggtaaggaggtagcttgctacttccctagagcggcggactggtgagtaacgcgtgggtgacgtaccctttggttggggatagccggtagaaataccgggtaataccgaataagacctctggtagaaagattagagaggaaagcggctccggccgcgccgaaggaa

SEQ ID NO: 989 - DNA, 225 bp, Unknown
  Encodes 16S rRNA from Clostridium IV
agagtttgatcatggctcaggacaaacgctggcggcatgcctaacacatgcaagtcgaacggagttcagttttagatcccttcggggtgacgaagcgaagacttagtggcggacgggtgagtaacgcgtgaggaacctgcctttcagagggggataacgtttggaaacgaacgctaataccgcataacacaaccgagtggcatcgcttggttgtcaaaggagcaa

SEQ ID NO: 990 - DNA, 225 bp, Unknown
  Encodes 16S rRNA from Cellulosilyticum
agagtttgatcatggctcaggatgaacgctggcggcgtgcataacacattcaagtcgaacggagttatttccttcgggggataacttagtggcggacgggtgagtaacgcgtgagtaacctgccatacacagggggataacgaccggaaacagtcgctaataccgcataacgcatgaaggtcacatggtctttatgccaaagatttatcggtgtatgatggactc

SEQ ID NO: 991 - DNA, 225 bp, Unknown
  Encodes 16S rRNA from Prevotella
agagtttgatcctggctcaggatgaacgctagctacaggcttaacacatgcaagtcgcggggcagcatggaggttgcttgcaacctctgatggcgaccggcgcacgggtgcgtaacgcgtatccaacctgccccttactctggaatagcccggcgaaagtcggattaatgccggatgttgtcagacgaggacatctgaatctgaccaaaggccctagggtcggta

SEQ ID NO: 992 - DNA, 225 bp, Unknown
  Encodes 16S rRNA from Pseudoflavonifractor
agagtttgatcatggctcaggacgaacgctggcggcgtgcttaacacatgcaagtcgaacgagaatcatatgacggagttttcggacaactgattatgaggaaagtggcggacgggtgagtaacgcgtgaggaacctgcctcggagtgggggataacacatcgaaaggtgtgctaataccgcataatgtatatcattcgcatgggagatataccaaagatttatt

SEQ ID NO: 993 - DNA, 225 bp, Unknown
  Encodes 16S rRNA from Clostridium III
agagtttgatcatggctcaggacgaacgctggcggcatgcctaacacatgcaagtcgaacggagatagtagagcttgctttacgatcttagtggcggacgggtgagtaacgcgtgagcaacctgcccttcagtggggaataatgttgagaaatcgacactaataccgcataaagtatcatgatcgcatggtcgagataccaaaggagcaattcgctgaaggatgg

SEQ ID NO: 994 - DNA, 225 bp, Unknown
  Encodes 16S rRNA from Oscillibacter
agagtttgatcctggctcaggacgaacgctggcggcgtgcttaacacatgcaagtcgaacgaagctctcacgcttgagttttcggacaagagggtgagaagacttagtggcggactggtgagtaacgcgtgagcaacctgccctccggtgggggacaacagttggaaacgactgctaataccgcataatgtacagagaccgcatgatctttgtaccaaagcttta

SEQ ID NO: 995 - DNA, 225 bp, Unknown
  Encodes 16S rRNA from Faecalibacterium
agagtttgatcatggctcaggatgaacgctggcggcgtgcataacacattcaagtcgaacggagttgcgatagaaagaggcttcggccaatggaaattgtaacttagtggcggacgggtgagtaacgcgtgagcaacctacctatgcgcgggggacaacagttggaaacgactgctaataccgcataaatcatgataaaggcatctttaacatggcaaagattaa

SEQ ID NO: 996 - DNA, 225 bp, Unknown
  Encodes 16S rRNA from Clostridium XlVb
agagtttgatcatggctcaggatgaacgctggcggcgtgcttaacacatgcaagtcgagcgaaggacaaagagcttgctttttgttacttagcggcggacgggtgagtaacgtgtgggcaatctgccctatgcagaggaataacatagagaaatttatgctaatgcctcataaactcttagaatcgcatggtttatagagaaaagatttatcggcataggaggag

SEQ ID NO: 997 - DNA, 225 bp, Unknown
  Encodes 16S rRNA from Eubacterium
agagtttgatcctggctcaggatgaacgctggcggcgtgcctaacacatgcaagtcgagcgagaaatcaggtgttgaaacttcggtagatacatctggtggacagcggcggacgggtgagtaacgcgtgggaaacctgcccttatctgagggatagccgagagaaatttcgagtaatacctcataatgcatcgagaccgcatggccatgatgccaaagatttatc

SEQ ID NO: 998 - DNA, 225 bp, Unknown
  Encodes 16S rRNA from Clostridium III
agagtttgatcatggctcaggacgaacgctggcggcgtgcctaacacatgcaagtcgaacggagccttttgccggaagggagcttgctccaggaaagtaaaagacttagtggcggacgggtgagtaacgcgtggataacctgccttagacagggggataacacagggaaacttgtgctaataccgcataagaccacactatggcatcatagaggggtcaaaggag

SEQ ID NO: 999 - DNA, 225 bp, Unknown
  Encodes 16S rRNA from Prevotella
agagtttgatcatggctcaggatgaacgctagctacaggcttaacacatgcaagtcgaggggcagcacggttgttgcttgcaacaactggtggcgaccggcgcacgggtgagtaacgcgtatccaacctgcccgcaaccgcggaatagcccgccgaaaggcggattaatgccgcatgagctcgcgcgagggcatcatttcgcgagcaaaggttcgttccggttgc

SEQ ID NO: 1000 - DNA, 225 bp, Unknown
  Encodes 16S rRNA from Paenibacillus
agagtttgatcctggctcaggatgaacgctggcggcgtgcctaatacatgcaagtcgaacggatgaggtagcaataccgattcagtggcgaacgggtgagtaacacgtaggtaacctgcccttaagactgggatacccaggcgaaagcttggctaataccggatatgagtagaagaggcatctcctttacttgaaagttgcgtttgcaacacttttggatggacc

SEQ ID NO: 1001 - DNA, 225 bp, Unknown
  Encodes 16S rRNA from Pedobacter
agagtttgatcatggctcaggatgaacgctagcggcaggcctaatacatgcaagtcgaacggtaaacgccccttcgggggtgtgagagtggcgcacgggtgcgtaacgcgtatgcaacccacccgctgccgggggatagcccggagaaatccgaattaataccccatgaggaggagatgaggcatctcatctttttcaaaacttcggtggcggcggacgggcatg

SEQ ID NO: 1002 - DNA, 225 bp, Unknown
  Encodes 16S rRNA from Butyricicoccus
agagtttgatcctggctcaggataaacgctggcggcgcacataagacatgcaagtcgaacgggaactttattgaagttatctgatataaagttctagtggcggactggtgagtaatgtataagcaacctgcctacaagaggggaataacagtgagaaatcattgctaataccgcataagctgtgagtatcgcatggtacaaacagaaaaggaagcaattctgctt

SEQ ID NO: 1003 - DNA, 225 bp, Unknown
  Encodes 16S rRNA from Clostridium XlVa
agagtttgatcatggctcaggatgaacgctggcggcgtgcctaacacatgcaagtcgaacggagtgttttaagccgattcttcggatgaagctttttacacttagtggcggacgggtgagtaacgcgtggagaacctgcctcacacagggggacagcagctggaaacggctgataataccgcatatgcccacgataccgcatggtattgcggggaaacatttatg

SEQ ID NO: 1004 - DNA, 225 bp, Unknown
  Encodes 16S rRNA from Roseburia
agagtttgatcatggctcaggatgaacgctggcggcgtgcctaacacatgcaagtcgaacggacccatggagatgattagcttgctatgaatttccggaaggttagtggcggacgggtgagtaacgcgtgggtaacctgcctcatacagggggatagcagttggaaacgactggtaataccgcataagcgcacagtaccgcatggtacagtgtgaaaagctccga

SEQ ID NO: 1005 - DNA, 225 bp, Unknown
  Encodes 16S rRNA from Hydrogenoanaerobacterium
agagtttgatcatggctcaggacgaacgctggcggcgtgcctaacacatgcaagtcgaacggactgataggagcttgctccttgaaagttagtggcggacgggtgagtaacgcgtgaggaacctgcctttcagagggggataacgtcttgaaaaggacgctaataccgcatgacaccggattgtcgcatggcagaccggtcaaaggagcaatccgctgaaagatg

SEQ ID NO: 1006 - DNA, 225 bp, Unknown
  Encodes 16S rRNA from Adhaeribacter
agagtttgatcctggctcaggatgaacgctggcggcaggcttaatacatgcaagtcgaacggtaaggccgagcgtagcaatacgcgaggtacacgagtggcgcacgggtgcgtaacgcgtatgcaacctgcccccttccgggacaaaacgtcgagaaattggcgctaatatcccatggcgacctcgggaggcatctctgggggtccaaagattcattggaagggg

SEQ ID NO: 1007 - DNA, 225 bp, Unknown
  Encodes 16S rRNA from Eubacterium
agagtttgatcatggctcaggattaacgctggcggcgtgcctaacacatgcaagtcgagcgagaattaggaaaatgatgcttcggttgattttttctaaggacagcggcggacgggtgagtaacgcgtgggcaacctgcccctttccggaggatagccaagggaaactttgaataatactccataaagcaagagtaccgcatgatacacttgccaaagatttatc

SEQ ID NO: 1008 - DNA, 225 bp, Unknown
  Encodes 16S rRNA from Bacteroides
agagtttgatcctggctcaggatgaacgctagctacaggcttaacacatgcaagtcgaggggcagcattaggtcagcttgctgacctagatggcgaccggcgcacgggtgagtaacgcgtatccaacctgccccctacccggggatagccttgcgaaagtaagattaatacccggtgctgttatgtttccgcatgggaatataacgaaagattcatcggtagggg

SEQ ID NO: 1009 - DNA, 225 bp, Unknown
  Encodes 16S rRNA from Victivallis
agagtttgatcctggctcagaacgaacgctggcggcatggattaggcatgcaagtcgaacgaagcagcaatgcttagtggcggaagggtgaggaacgcgtgagtaatctgcccccaagttgggaataacagctggaaacggttgctaataccgaatgtggctgcctggtcgcatgatcgggcagttaaagatttattgcttggggatgagctcgcgtcccattag

SEQ ID NO: 1010 - DNA, 225 bp, Unknown
  Encodes 16S rRNA from Roseburia
agagtttgatcatggctcaggatgaacgctggcggcgtgcttaacacatgcaagtcgaacgaagttagattggaatgcggcttcggccaaaggaagatttaattgagtggcggacgggtgagtaacgcgtgggtaacctaccttacacagggggataacgattggaaacgatcgctaataccgcataagaccacagtaccgcatggtacaggggtaaaagaatta

SEQ ID NO: 1011 - DNA, 225 bp, Unknown
  Encodes 16S rRNA from Treponema
agagtttgatcctggctcagaacgaacgctggcggcgcgtcttaagcatgcaagtcgagcgggaatacctagcttgctaggtatgagagcggcggactggtgagtaacacgtagataacgcaccctctagacggggatagctgccagaaatggcagataataccggatgtgaacgtatgccgtgaaggtgtacgtggaaaggagcttcggctccgctagaggaac

SEQ ID NO: 1012 - DNA, 225 bp, Unknown
  Encodes 16S rRNA from Prevotella
agagtttgatcatggctcaggatgaacgctagctacaggcttaacacatgcaagtcgaggggcatcacggggttggcttgccatccctggtggcgaccggcgcacgggtgagtaacgcgtatccaacctgccccgaaccgcggtatagcccgccgaaaggcggattaatcccgcatgtggtcgtgagatgacatctgaccacgactaaaggtattttccggttcg

SEQ ID NO: 1013 - DNA, 225 bp, Unknown
  Encodes 16S rRNA from Prevotella
agagtttgatcatggctcaggatgaacgctagctacaggcttaacacatgcaagtcgaggggcagcactgggtgcgcttgcgcaccctggtggcgaccggcgcacgggtgagtaacgcgtatccaacctgcccgcaaccgcggaatagcccgccgaaaggcggattaatgccgcatgagctcgcgcgatggcatcttatcgcgagcaaaggtgttttccggttgt

SEQ ID NO: 1014 - DNA, 225 bp, Unknown
  Encodes 16S rRNA from Hydrogenoanaerobacterium
agagtttgatcatggctcaggacgaacgctggcggcgcgcctaacacatgcaagtcgaacgggactagtgaccggagattagagcttgttgttctagtttgcgatcactagttcagtggcggacgggtgagtaaagcatgagcaacctgcctagtagagggggatagcttttggaaacagaagataataccgcatgaatcagagatttcgcatgagatttttgga

SEQ ID NO: 1015 - DNA, 225 bp, Unknown
  Encodes 16S rRNA from Clostridium XlVa
agagtttgatcatggctcaggatgaacgctggcggcgtgcctaacacatgcaagtcgaacgagggtcctaaacctgagattcgtcgaaggggaaggaattccgagtggcggatgggtgagtaacgcgtggagaacctgccctttgctgggggataacaactggaaacggttgacaataccgcataagctcgatggaccgcatgatctatcgaggaaagatttatc

SEQ ID NO: 1016 - DNA, 225 bp, Unknown
  Encodes 16S rRNA from Bacteroides
agatttgatcctggctcaggatgaacgctagctacaggcttaacacatgcaagtcgaggggcagcatggtcttagcttgctaaggccgatggcgaccggcgcacgggtgagtaacgcgtatccaacctgccgtccagtaggggacagcccgtagaaatgcggattaataccctatgttctccgaggatgacatcagattcggagtaaagattcatcgctggacga

SEQ ID NO: 1017 - DNA, 155 bp, Unknown
  Encodes 16S rRNA from Bacteroides
agagtttgatcctggctcaggatgaacgctagctacaggcttaacacatgcaagtcgaggggtaacgcgaggaagacagcacgtaaataaacgtgttatttgacgttagagtgtgaataagcaccggcaaactccgtgccagcagccgcggtaat

SEQ ID NO: 1018 - DNA, 225 bp, Unknown
  Encodes 16S rRNA from Lactobacillus
agagtttgatcctggctcaggatgaacgctggcggcgtgcctaatacatgcaagtcgaacgagattttattaattgattacttcggtatgatttttctaaaatcgagtggcggacgggtgagtaacacgtgggtaacctgcccttaagtaggggataacatttggaaacagatgctaataccgtataaatctcagaaacacatgtttctgagctgaaaggcggct

SEQ ID NO: 1019 - DNA, 225 bp, Unknown
  Encodes 16S rRNA from Adlercreutzia
agagtttgatcctggctcaggatgaacgctggcggcgtgcctaacacatgcaagtcgaacggttaagccggcttcggccgggtatacagtggcgaacgggtgagtaacacgtgaccaacctgccccgcgctccgggacaaccgctggaaacggcggctaataccggatactcccgcctccccgcatggggcggcggggaaagccccgacggcgcgggatggggtc

SEQ ID NO: 1020 - DNA, 225 bp, Unknown
  Encodes 16S rRNA from Dethiosulfovibrio
agagtttgatcatggctcaggatgaacgctggcggcgtgcttaacacattcaagtcgaacggagtgtttttgaaagcttgcttttgagaatacttagtggcggacgggtgagtaatgcatgagcaacctgcctttaagagggggataacacagagaaatctgtgctaataccgcatagaacactgagatggcatcatcatagtgggaaaggagcaatccgcttaa

SEQ ID NO: 1021 - DNA, 225 bp, Unknown
  Encodes 16S rRNA from Lutispora
agagtttgatcatggctcaggacgaacgctggcggcgtgcttaaaacatgcaagtcgaacggagattttagggagcttgcttcttgaaatcttagtggcggacgggtgagtaacacgtgagcaacctgcctatcacagggggataacacttagaaataggtgctaataccgcatatgaccacagaccggcatcggtcagaggtgaaaggagttaaatctggtgat

SEQ ID NO: 1022 - DNA, 225 bp, Unknown
  Encodes 16S rRNA from Turicibacter
agagtttgatcctggctcaggatgaacgctggcggcgtgcctaatacatgcaagtcgaacggagcacttcggtgcttagtggcgaacgggtgagtaacacataaacaatctacccttaagtctgggataacggttggaaacgaccgctaataccggataggtaaaaccgaggcatcttggttttattaaagctgggctacagcgctaaaggatgagtttatgtcg

SEQ ID NO: 1023 - DNA, 225 bp, Unknown
  Encodes 16S rRNA from unknown taxa
agagtttgatcctggctcaggacgaacgctggcggtgtgcctcatacatgcaagtcgaacgataaggttccttcgggaatacataagtggcggacgggtgagtacaacataggaaatctgccctaaactgggggacaacagagggaaactcctgctaataccccatacgagcttggttgaaataccaatcttgaaagctccggcggtttgggatgagcctgtgcc

SEQ ID NO: 1024 - DNA, 225 bp, Unknown
  Encodes 16S rRNA from Clostridium sensu stricto
agagtttgatcatggctcaggacgaacgctggcggcatgcctaacacatgcaagtcgaacggaggtggaaacaccttagtggcgaacgggtgagtaacgcgtgagtaacctgccttatacacagggataccagttagaaatgactgctaataccggataagaccacagtccggcatcggacaggggtcaaagtgaattagcggtataagatgggctcgcgtccaa

SEQ ID NO: 1025 - DNA, 225 bp, Unknown
  Encodes 16S rRNA from unknown taxa
agagtttgatcatggctcaggatgaacgctggcggcgtgcttcatacatgcaagtcgaacgtgaagctgacttcggtcagtggaaagtggcggacgggtgagtaatacataggaaatctgcccttaggaaggggataacagtcggaaacgattgctaataccctatatgagcttggttgcaataccaatcttgaaaactccggtgcctaaggatgagcctgtgcc

SEQ ID NO: 1026 - DNA, 225 bp, Unknown
  Encodes 16S rRNA from Bulleidia
agagtttgatcatggctcaggatgaacgctggcggcgtgcctaatacatgcaagtcgaacgagagcgaccagcttgctggtcaatcgagtggcgaacgggtgagtaacacataaacaatctgccctggagactgggataacgtagggaaacccacgctaataccggataggcagtaaggggacatccccatactgttaaagctgggctacagcactgcaggatga

SEQ ID NO: 1027 - DNA, 225 bp, Unknown
  Encodes 16S rRNA from Aquiflexum
agagtttgatcatggctcaggatgaacgctggcggcaggcttaatacatgcaagtcgaacggtaaggccgagcgtagcaatacgcgaggtacacgagtggcgcacgggtgcgtaacgcgtatgcaacctgcccccttccgggacaaaacgtcgagaaattggcgctaatatcccatggcgacccttgggggcatccccgggggtccaaagattcattggaagggg

SEQ ID NO: 1028 - DNA, 225 bp, Unknown
  Encodes 16S rRNA from Lachnospiracea incertae sedis
agagtttgatcctggctcaggatgaacgctggcggcgtgcttaacacatgcaagtcgaacgaagcacttattgagaaccttcgggtgatcggcaagtgactgagtggcggacgggtgagtaacgcgtgggtaacctgccctgtacagggggataacagccagaaatggctgctaataccgcataagcccgggggggagcattttctcccggggaaaactccggtg

SEQ ID NO: 1029 - DNA, 225 bp, Unknown
  Encodes 16S rRNA from Lachnospiracea incertae sedis
agagtttgatcctggctcaggatgaacgctggcggcgtgcttaacacatgcaggtcgaacgaagccccggaagcggatcttcggaaaagcggacgggagacttagtggcggacgggtgagtaacgcgtgggcaacctgcccttgggagggggacaacagccggaaacggctgctaataccgcatgatccggcggctccgcatgggggtgccgggaaaggagcgat

SEQ ID NO: 1030 - DNA, 225 bp, Unknown
  Encodes 16S rRNA from Clostridium III
agagtttgatcctggctcaggataaacgctggcggcgcacataagacatgcaagtcgaacgaacgagtacagattctttacgtttttgtatgagttagtggcggactggtgagtaacgcgtgagcaacctgcctataagaggggaataacggagagaaattttcgctaataccgcataagctgatagagtcgcatgacttagtcagaaaaggagcaatccgctta

SEQ ID NO: 1031 - DNA, 225 bp, Unknown
  Encodes 16S rRNA from Roseburia
agagtttgatcatggctcaggatgaacgctggcggcgtgcttaacacatgcaagtcgaacggacttaccctggatgaggccctcgggcggattcctaagtaagttagtggcggacgggtgagtaacgcgtgggtaacctgcctcacattgggggataacgattggaaacgatcgctaataccgcataagaccacggcaccgcatggtgctgaggtaaaaactccg

SEQ ID NO: 1032 - DNA, 225 bp, Unknown
  Encodes 16S rRNA from Glaciecola
agagtttgatcatggctcaggatgaacgctggcggcgtgcctaacacatgcaagtcgaacgggactatttggggaatattgcacaatgggggaaaccctgatgcagccatgccgcgtgtgtgaagaaggccttcgggttgtaaagcacttttgcattcgaggaagacagcgtataaacaaatgcgctatttgacgttagagtgtgaataagcaccggcaaactcc

SEQ ID NO: 1033 - DNA, 225 bp, Unknown
  Encodes 16S rRNA from Clostridium XlVa
agagtttgatcatggctcaggatgaacgctggcggcgtgcttaacacatgcaagtcgaacgaggaattaacattgaaattttcggatggatttgttttttccgagtggcggacgggtgagtaacgcgtgggtaacctgccttacacagggggacaacagccggaaacggctgctaataccgcataacctgctagagtcgcatgactcagacagaaaagatttatc

SEQ ID NO: 1034 - DNA, 225 bp, Unknown
  Encodes 16S rRNA from Hydrogenoanaerobacterium
agagtttgatcatggctcaggagaaacgctggcggcgcacataagacatgcaagtcgaacggaaccaagtcgaatgtttacatgagacggaagtttagtggcggacgggtgagtaacacgtgagcaacctgcctttaagagggggataacattgagaaatcagtgctaataccgcataaagcatctttaccgcatgatagagatagccaaaggagaaatccgctt

SEQ ID NO: 1035 - DNA, 225 bp, Unknown
  Encodes 16S rRNA from Clostridium IV
agagtttgatcctggctcaggatgaacgctggcggcgtgcataacacattcaagtcgaacgaagcaccggcgaggaagtcttcggacggaattgcccttgacttagtggcggacgggtgagtaacgcgtgagcaaccttcctggcagtgagggataacacagggaaacttgtgctaataccgcatgacgcacgattgtcgcatggcagacgtgccaaagattaat

SEQ ID NO: 1036 - DNA, 225 bp, Unknown
  Encodes 16S rRNA from Sphaerobacter
agagtttgatcatggctcaggataaacgctggcggcgtgcctaatgcatgcaagtcggacgggagccccttcgggggtcgaccgtggcggacgggtgaggaacacgtggctaacctgcccatcagtgggggataactccgggaaaccggagctaagaccgcatacgttcagtttcggggacggaattgaggaaagctttcgagcgctgatggagggggctgcggc

SEQ ID NO: 1037 - DNA, 225 bp, Unknown
  Encodes 16S rRNA from unknown taxa
agagtttgatcctggctcaggacgaacgctggcggcgtgcttcatacatgcaagtcgaacgataaggtctcttcggagacacataagtggcggacgggtgagtaatgtgtagagaatctgccctttagtgggggacaacagttggaaacgactgctaataccgcatatgcgcgtacctgtaatggtattcgtgaaaactccggtgctaaaggatgagtctgcatc

SEQ ID NO: 1038 - DNA, 225 bp, Unknown
  Encodes 16S rRNA from Prevotella
agagtttgatcctggctcaggatgaacgctagctacaggcttaacacatgcaagtcgaggggcagcatgtcggtggcttgccaccggcgatggcgaccggcgcacgggtgagtaacgcgtatccaacctgccctcaaccgcggaatagcccgccgaaaggcggattaatgccgcatgagctcgcgcgggggcatctgcccgcgagcaaaggtttgttccggttgg

SEQ ID NO: 1039 - DNA, 225 bp, Unknown
  Encodes 16S rRNA from Turicibacter
agagtttgatcctggctcaggatgaacgctggcggcgtgcctaatacatgcaagtcgaacgagatagcaatatcgagtggcgaacgggtgagtaacacgtaggtaacctgccttacagtttgggataccctggcgaaagctaggctaataccgaataattggattggaggcatctccgatctctaaaaggggcccttaaagcctcgctgaatgatggacctgcgg

SEQ ID NO: 1040 - DNA, 225 bp, Unknown
  Encodes 16S rRNA from Ruminococcus
agagtttgatcatggctcaggacgaacgctggcggcacgcttaacacatgcaagtcgaacggagatcattctttcggggatgatcttagtggcggacgggtgagtaacacgtgagcaacctgccttacggagaggaataatgattggaaacgatcactaataccacataacatataggtgatgcatatcagctatatcaaagatttatcgccgtaagatgggctc

SEQ ID NO: 1041 - DNA, 225 bp, Unknown
  Encodes 16S rRNA from Clostridium IV
agagtttgatcatggctcaggattaacgctggcggcgtgcataacacattcaagtcgaacggagaaggggcttcggccccggatcagtggcggacgggtgagtaacgcgtgagtaacctgcctgtgtgaggggaataacagatcgaaaggcctgctaataccgcatgacgtacgactgtcgcatggcagaggtaccaaagatttatcgcacacagatggactcgc

SEQ ID NO: 1042 - DNA, 225 bp, Unknown
  Encodes 16S rRNA from Clostridium XlVa
agagtttgatcatggctcaggatgaacgctggcggcgcgcataacacatgcaagtcgaacggagtgtaattgaaacctagtgattttacacttagtggcggacgggtgagtaacgcgtgggtaacctgcctggtattgggggacaacagttagaaatgactgctaataccgcatacgacgtcggggaggcatctccctgacgggaaaggaattatccgatatcag

SEQ ID NO: 1043 - DNA, 225 bp, Unknown
  Encodes 16S rRNA from Saccharofermentans
agagtttgatcatggctcaggacgaacgctggcggcgtgcctaacacatgcaagtcgagcggaactgattctggaaagcttcggccggaagggatgagtttagcggcggacgggtgagtaacgcgtgagcaacctgtccttcacagggggataagacagcgaaagttgttctaataccgcataggaccacgggtgggcatccatctggggtgaaaggagcaatcc

SEQ ID NO: 1044 - DNA, 225 bp, Unknown
  Encodes 16S rRNA from Clostridium XlVb
agagtttgatcctggctcaggatgaacgctggcggcgtgcttaacacatgcaagtcgaacgaagatatttaagatgaaggcttcggtctgatttttttatattcttagtggcggacgggtgagtaacgcgtgggcaacctgccctttactggggaataatcattggaaacgatgactaataccgcatgtcaccgaggactggcatctttcctcggaaaaaggagc

SEQ ID NO: 1045 - DNA, 225 bp, Unknown
  Encodes 16S rRNA from Ruminococcus
agagtttgatcatggctcaggacgaacgctggcggcacgcttaacacatgcaagtcgaacgaaaaagtttcaccgcagcttgctgcaccgaaactttttagtggcggacgggtgagtaacacgtgagcaatctgccttttagagggggataccagttggaaacgactgttaataccgcataacatatcgaaaccgcatgattttgatatcaaagatttatcgctg

SEQ ID NO: 1046 - DNA, 178 bp, Unknown
  Encodes 16S rRNA from Fibrobacter
agagtttgatcctggctcaggatgaacgctggcggcgcgcctaacacatgcaagtcgaacggaagaagcatttcggtgtgtaaaccactgtcgtgagggaataaggcgtcttctcggagacgttgaatgtacctcgaaaggaagcaccggcaaacttcgtgccagcagccgcggtaat

SEQ ID NO: 1047 - DNA, 225 bp, Unknown
  Encodes 16S rRNA from Proteiniclasticum
agagtttgatcatggctcaggacgaacgctggcggcgtgcttaacacatgcaagtcgtacggggtatagcaatatacctagtggcgaacgggtgagtaacacgtgagtaacctgccctatacagggggacaacagctggaaacggctgctaataccgcataagaccacagcaccgcatggtgcagaggtaaaaggctacggccggtataggatgggcttgcgtac

SEQ ID NO: 1048 - DNA, 225 bp, Unknown
  Encodes 16S rRNA from Anaeroplasma
agagtttgatcctggctcaggattaacgctggcggcgtgcctaatacatgcaagtcgaatggttagcttgctaaccatggcgaacgggtgagtaacacgtaggcaacctgtctataagacgaggataaccattggaaacgatggataatactggataggatattggaaggcatcttctaatatttaaagatttatcactaatagaggggcctgcggcgcattagc

SEQ ID NO: 1049 - DNA, 225 bp, Unknown
  Encodes 16S rRNA from unknown taxa
agagtttgatcctggctcaggacgaacgctggcggtgtgcctcatacatgcaagtcgaacgataaggttccttcgggaatacataagtggcggacgggtgagtacaacataggaaatctgccctaaagcgggggacaacagagggaaacttctgctaataccccatatgagcttggttgaaataccaatcttgaaagatttatcactttaggatgagcctgtgcc

SEQ ID NO: 1050 - DNA, 225 bp, Unknown
  Encodes 16S rRNA from Algoriphagus
agagtttgatcctggctcaggatgaacgctggcggcaggcctaatacatgcaagtcgcgcgggaattgccctttcgggggtgatgagagcggcggacgggtgcgtaacgcgtatgcaaccaacccccgacaggcggatagccggtggaaacgccggataatacgccatgaaccctttttggggcatcccagggaggggaaagcggagacgcggtcggggacgggc

SEQ ID NO: 1051 - DNA, 225 bp, Unknown
  Encodes 16S rRNA from Clostridium XlVa
agagtttgatcatggctcaggatgaacgctggcggcgtgcttaacacatgcaagtcgaacgaagcgtctcgcccgaagaagcgaagtgcttgcacggagtggattcaattgagacgacttagtggcggacgggtgagtaacgcgtgggtaacctgccgtatgcagggggacaacagttggaaacgactgctaataccgcataagcgcacggctcggcatcgagca

SEQ ID NO: 1052 - DNA, 225 bp, Unknown
  Encodes 16S rRNA from Howardella
agagtttgatcatggctcaggataaacgctggcggcgcacataagacatgcaagtcgaacggacttaacttctagcttgctagaagagcggttagtggcggactggtgagtaacacgtaagaaatctgcctatcagaggggaataacagtgagaaatcattgctaataccgcatatgccataatcatcgcatgatgatagtgggaaagaagcaattcgctgatag

SEQ ID NO: 1053 - DNA, 225 bp, Unknown
  Encodes 16S rRNA from Clostridium XlVa
agagtttgatcatggctcaggatgaacgctggcggcgtgcctaacacatgcaagtcgaacgggggcgttccgccggggaggcttcggccgaaccatggggcgcccgagtggcggacgggtgagtaacgcgtggacaacctgccccccaccggggaataacacctggaaacaggtgctaataccgcatgagccccagagcccgcatgggcactgggggaaagctcc

SEQ ID NO: 1054 - DNA, 225 bp, Unknown
  Encodes 16S rRNA from Barnesiella
agagtttgatcatggctcaggatgaacgctagcgacaggcctaacacatgcaagtcgaggggcagcgagaggaaagcttgctttctttgtcggcgaccggcgcacgggtgcgtaacgggtgtgcaatctgcccataatcggggcatagcctaacgaaagttggattaattccccatgtgctatggagaggcatctcttcgtagtgaaacgtaaggattatggttg

SEQ ID NO: 1055 - DNA, 225 bp, Unknown
  Encodes 16S rRNA from Clostridium IV
agagtttgatcctggctcaggacgaacgctggcggcgtgcctaacacatgcaagtcgagcggggactttacgacagatttgaagacttcggttgaatatgaagatgtaaagttctagcggcggacgggtgagtaacgcgtgagcaacctgtcccttacagggggataacacagcgaaagttgtactaataccgcatgagaccacagtatcacatggtacaggggt

SEQ ID NO: 1056 - DNA, 225 bp, Unknown
  Encodes 16S rRNA from Prevotella
agagtttgatcatggctcaggatgaacgctagctacaggcttaacacatgcaagtcgaggggcagcatgtcggtggcttgccaccggcgatggcgaccggcgcacgggtgagtaacgcgtatccaacctgcccacaacctccgaatagcccgccgaaaggcggattaatgcgggatgtggtctgaagaagacatctgaactagaccaaaggttttttccggttgt

SEQ ID NO: 1057 - DNA, 225 bp, Unknown
  Encodes 16S rRNA from Clostridium XlVa
agagtttgatcctggctcaggacgaacgctggcggcgtgcttaacacatgcaagtcgaacgaggataatgacttcggtcattattcgagtggcggacgggtgagtaacgcgtgagcaatctgtccttaagagggggataacaactggaaacagttgctaataccgcataagaccacggcttcacatggagctgaggtaaaagaagcaattcgcttaagggtgagc

SEQ ID NO: 1058 - DNA, 225 bp, Unknown
  Encodes 16S rRNA from Butyricimonas
agagtttgatcctggctcaggatgaacgctagcggcaggcttaacacatgcaagtcgaggggcagcgcggggtagcaatactctggcggcgaccggcggaagggtgcgtaacgcgtgagcaacttgcccgtcactgtgggataggcactggaaacggtgtgtaataccacgtaatacatttgctcgcatgggtggatgttgaaaggattaccggtgacggatggg

SEQ ID NO: 1059 - DNA, 225 bp, Unknown
  Encodes 16S rRNA from Blautia
agagtttgatcctggctcaggatgaacgctggcggcgtgcctaacacatgcaagtcgaacggagcttatttctgcggagatttcggtcaaagcgggtttaagtttagtggcggacgggtgagtaacgcgtggagaacctgccctgtaccgggggataacagccggaaacggctgctaataccgcataagcgcacgaaggcgcatgccttagtgtgaaaaactccg

SEQ ID NO: 1060 - DNA, 204 bp, Unknown
  Encodes 16S rRNA from Prevotella
agagtttgatcatggctcaggatgaacgctagctacaggctttggtcaatgggcgcgagcctgaaccagccaagtagcgtgcaggatgacggccctatgggttgtaaactgcttttatgcggggataaagttcactacgtgtagtgttttgtaggtaccgcatgaataaggaccggctaattccgtgccagcagccgcggtaat

SEQ ID NO: 1061 - DNA, 225 bp, Unknown
  Encodes 16S rRNA from Clostridium XlVa
agagtttgatcctggctcaggatgaacgctggcggcgtgcctaacacatgcaagtcgaacggggtacagacgctgtgagaagaagtgcttgcacggaatcaaacttgtttgtacctagtggcggacgggtgagtaacgcgtggaaaacctgcctcatacagggggataacaggaagaaattcctgctaataccgcataagcgcacaagagggcatcctcaggtgt

SEQ ID NO: 1062 - DNA, 225 bp, Unknown
  Encodes 16S rRNA from Blautia
agagtttgatcatggctcaggatgaacgctggcggcgtgcctaacacatgcaagtcgaacgggacttatcaggaaaaaagcttcggcagatggaatggtaagtctagtggcggacgggtgagtaacgcgtggggaacctgccctgtactgggggataacagtgagaaatcactgctaataccgcataagcgcacagtaccgcatggtacagtgtgaaaaactccg

SEQ ID NO: 1063 - DNA, 225 bp, Unknown
  Encodes 16S rRNA from Clostridium IV
agagtttgatcctggctcaggacgaacgctggcggcgcgcctaacacatgcaagtcgaacgggaaatatctgaaagcttgcttttggatatttttagtggcggacgggtgagtaacacgtgagcaacctgccttagagagggggataacgtctggaaacggacgctaataccgcataacatcacgatatggcatcgtattgtgatcaaaggagcaatccgcttta

SEQ ID NO: 1064 - DNA, 225 bp, Unknown
  Encodes 16S rRNA from Flavobacterium
agagtttgatcatggctcaggatgaacgctagcggcaggcttaacacatgcaagtcgaggggcagcatgagagcgtagcaatacattcttgatggcgaccggcgcaagggtgcgtaacgcgtgagcaacttgcccgcatcaggggcataatcggtggaaacgccgtctaactccccataacatacgaggtggcatcactttgtattgaaatccttggaggatgcg

SEQ ID NO: 1065 - DNA, 225 bp, Unknown
  Encodes 16S rRNA from Prevotella
agagtttgatcctggctcaggatgaacgctagctacaggcttaacacatgcaagtcgaggggcagcatgtcgtgtgcttgcacacgatgatggcgaccggcgcacgggtgagtaacgcgtatccaacctgcccatgaccccgggatagcccgctgaaaagcggattaacaccggatgcggtcgaacgaggacatctgatttcgaccaaagcttcggcggtcatgg

SEQ ID NO: 1066 - DNA, 225 bp, Unknown
  Encodes 16S rRNA from Clostridium XlVa
agagtttgatcctggctcaggatgaacgctggcggcgtgcctaacacatgcaagtcgaacggggttgtgcgctgaggaagcttcggcagaatcttgcacaacctagtggcggacgggtgagtaacgcgtggacaacctgcccctgcctgggggacaacagccggaaacggctgctaataccgcataagctctgttattcgcatgggaagcagaggaaaggagaga

SEQ ID NO: 1067 - DNA, 225 bp, Unknown
  Encodes 16S rRNA from Clostridium XlVa
agagtttgatcctggctcaggatgaacgctggcggcgtgcttaacacatgcaagtcgaacgaagcactggggatgaagttttcggacagaattccctttgacttagtggcggacgggtgagtaacgcgtgggtaacctgcctcacactgggggacaacagctggaaacggctgctaataccgcataagcgcacgaagccgcatggctatgtgtgaaaaactccgg

SEQ ID NO: 1068 - DNA, 225 bp, Unknown
  Encodes 16S rRNA from Eubacterium
agagtttgatcctggctcaggatgaacgctggcggcgtgcctaacacatgcaagtcgagcgagaaacttatgtgatgcgatttcggtcaaatcttttaagtggaaagcggcggacgggtgagtaacgcgtaggcaacctgcccttagcagggggatagccattggaaacgatgattaaaaccccataatacggatatatcacatgttaaatccgtcaaagattta

SEQ ID NO: 1069 - DNA, 225 bp, Unknown
  Encodes 16S rRNA from Butyricicoccus
agagtttgatcctggctcaggataaacgctggcggcgtgcataacacattcaagtcgaacggacgatacgagaaacttcggttttttgtaaagttagtggcggacgggtgagtaacacgtgagcaatctgcctttgattgggggataacgcagggaaacttgtgctaataccgcataaagtgccgaggacgcatgaccacggcaccaaagctccggcgatcaaag

SEQ ID NO: 1070 - DNA, 225 bp, Unknown
  Encodes 16S rRNA from Fluviicola
agagtttgatcatggctcaggatgaacgctagcggcaggcttaacacatgcaagtcgaggggtaacaggcggtagcaatactgtgctgacgaccggcgcacgggtgcgtaacgcgtatgcaacctaccttcaacagggggataagcgggagaaattctgtctaataccccatagagtctagagggcacatgttttttagactaaagccttggtggttggagatgg

SEQ ID NO: 1071 - DNA, 225 bp, Unknown
  Encodes 16S rRNA from Anaerovibrio
agagtttgatcatggctcaggacgaacgctggcggcgtgcttaacacatgcaagtcgaacggggcgaagaagagcttgctctttggagcctagtggcaaacgggtgagtaacgcgtaggcaacctgcccttcagatggggacaacacctcgaaaggggtgctaataccgaatgacgtatgctggtcgcatgaccggcataccaaaggccgggcaaccggtcactg

SEQ ID NO: 1072 - DNA, 225 bp, Unknown
  Encodes 16S rRNA from Blautia
agagtttgatcctggctcaggatgaacgctggcggcgtgcctaacacatgcaagtcgaacggatttcctaatgacagaggcttcggccaacgaagtttggaagttagtggcggacgggtgagtaacgcgtggagaacctgccctgtactgggggataacatcaggaaactggtgctaaaaccgcataagcgcacaagaccgcatggtcaagtgtgaaaaactccg

SEQ ID NO: 1073 - DNA, 225 bp, Unknown
  Encodes 16S rRNA from unknown taxa
agagtttgatcctggctcagaacgaacgctggtagcgtggattaggcatgcaagtcgaacgggatccgggaggtagcaatacttcctggtgagagtggcggattggggaggaacacgtgagcaacctgcctttgagtcggggaaaaccgttggaaacgacggctaataccggatgtggcgcccggagacatcttcggagcgctaaagggggccgcaaggctctcg

SEQ ID NO: 1074 - DNA, 225 bp, Unknown
  Encodes 16S rRNA from Clostridium sensu stricto
agagtttgatcctggctcaggacgaacgctggcggcatgcctaacacatgcaagtcgaacggaataagaatggttgtagcgatactttcgttcttatttagtggcgaacgggtgagtaacacgtgagcaacctgccttctactcagggataacagccggaaacggctgctaataccggataagaccacgccgaggcatctcggaggggtcaaagcgccttagcgg

SEQ ID NO: 1075 - DNA, 225 bp, Unknown
  Encodes 16S rRNA from Spirochaeta
agagtttgatcctggctcagaacgaacgctggcggcgcgtcttaagcatgcaagtcgagcggcaagctgccttcgggcagcctagagcggcggactggtgagtaacgcgtggatgacgcaccctcctgatcgggatagcctgtggaaacacagggtaataccggataagcccgcccgcgttggaggcgagcggggaaaggggctattgccccgctggaggagcgg

SEQ ID NO: 1076 - DNA, 225 bp, Unknown
  Encodes 16S rRNA from Clostridium XI
agagtttgatcatggctcaggatgaacgctggcggcgtgcttaacacatgcaagtcgaacggagacatgttttggaagttttcggatggaagagatatgtcttagtggcggacgggtgagtaacacgtaaacaatctgcctttgagagcgggacaacagatagaaatatttgctaataccgcataagaccacaggttcgcatgaactaggggtaaaaggggagca

SEQ ID NO: 1077 - DNA, 225 bp, Unknown
  Encodes 16S rRNA from Anaerovorax
agagtttgatcctggctcaggatgaacgctggcggcgtgcctaacacatgcaagtcgagcgagaaacctctttgaagatacttcggttgattctgtgaggcggaaagcggcggacgggtgagtaacgcgtaggcaacctgccccatgcagagggatagcctcgggaaaccgggattaaaacctcataatacggaagagagacatctctttttcgtcaaagattta

SEQ ID NO: 1078 - DNA, 225 bp, Unknown
  Encodes 16S rRNA from Roseburia
agagtttgatcctggctcaggatgaacgctggcggcgtgcttaacacatgcaagtcgaacgaatttctttcagaacgcggcttcggccaagggacggaagaagtgagtggcggacgggtgagtaacgcgtgggtaacctgcctcacattgggggataccagtcggaaacgactgctaataccgcataagaccccggcaccgcatggtgctgaggccaaaactccg

SEQ ID NO: 1079 - DNA, 225 bp, Unknown
  Encodes 16S rRNA from Mucilaginibacter
agagtttgatcatggctcaggatgaacgctagcggcaggcctaatacatgcaagtcgaacgggatgggccccttcgggggccctgagagtggcgcacgggtgcgcaacgcgtatgcaaccaacccccgacaggcggatagccggtggaaacgccggataatacgccatggttccggtggagggcatcctctactggataaagccgagaggcggtcggggacgggc

SEQ ID NO: 1080 - DNA, 225 bp, Unknown
  Encodes 16S rRNA from Clostridium XI
agagtttgatcctggctcaggatgaacgctggcggcatgcctaacacatgcaagtcgaacggagatagaaatatcttagtggcgaacgggtgagtaacacgtgagcaacctgccttgtacacagggataacagatggaaacatctgctaataccggataagaccacagaccggcatcggtcaggggtaaaagtgatttagcggtacaagatgggctcgcgtccaa

SEQ ID NO: 1081 - DNA, 225 bp, Unknown
  Encodes 16S rRNA from Lachnospiracea incertae sedis
agagtttgatcatggctcaggatgaacgctggcggcgtgcctaacacatgcaagtcgaacgaagctctgctgcggaactcttcggagggaaggagcggatgactgagtggcggacgggtgagtaacgcgtgggtaacctgccctgtacagggggacaacagttagaaatgactgctaataccgcataagcgtacggtgccgcatggcacagtgcgaaaaaccgag

SEQ ID NO: 1082 - DNA, 225 bp, Unknown
  Encodes 16S rRNA from Prevotella
agagtttgatcatggctcaggatgaacgctagctacaggcctaacacatgcaagtcgaggggcagcatggaggttgcttgcaacttccgatggcgaccggcgaatgggtgagtcacgcgtgtccaacctgcctccggcccggggatagcccttggaaatgaggattaagacccgataggtggcgcttccgcatggcggcgccatgaaacgagaccggagatgggg

SEQ ID NO: 1083 - DNA, 225 bp, Unknown
  Encodes 16S rRNA from Clostridium III
agagtttgatcctggctcaggacgaacgctggcggcgtgcctaacacatgcaagtcgaacgagaatttagtaaatgatttcttcggaatgattttgctaaaggaaagtggcggacgggcgagtaacgcgtgagtaacctgcccataagagggggataatccttggaaacgaggactaataccgcatattgtagctttaccgcatggtttagttatgaaagattta

SEQ ID NO: 1084 - DNA, 225 bp, Unknown
  Encodes 16S rRNA from Lachnospiracea incertae sedis
agagtttgatcctggctcaggataaacgctggcggcgtgcttaacacatgcaagtcgaacgaagcattttgccacgatcccttcggggtgacggcattctgacttagtggcggacgggtgagtaacgcgtggacaacctgccgcatgcagggggataacagccggaaacggctgctaataccgcataagcgcacagtgccgcatggcacggtgtgaaaaactttc

SEQ ID NO: 1085 - DNA, 225 bp, Unknown
  Encodes 16S rRNA from Coprococcus
agagtttgatcctggctcaggatgaacgctggcggcgtgcttaacacatgcaagtcgaacggagtttagcgcttccgaagcttcggcagaggattgttaaacttagtggcggacgggtgagtaacgcgtgggtaacctgccatgtacagggggataacacttagaaataggtgctaataccgcataagcgcacaggaccgcatggtccggtgtgaaaaactgagg

SEQ ID NO: 1086 - DNA, 225 bp, Unknown
  Encodes 16S rRNA from Acholeplasma
agagtttgatcctggctcaggatgaacgctggcggcgtgcctaatacatgcaagtcgaacgctaactttcgggttagagtggcgaacgggtgagtaacacgtaggtaacctgcccataagacgaggataactactggaaacggtagctaatactggatagtatatagagtcgcatggctttatatttaaagatgccttcaagcatcacttatggatggacctgcg

SEQ ID NO: 1087 - DNA, 225 bp, Unknown
  Encodes 16S rRNA from Clostridium III
agagtttgatcctggctcaggacgaacgctggcggcgtgcctaacacatgcaagtcgaacgagaatttagcaaatgatttcttcggaatgattttactaaaggaaagtggcggacgggcgagtaacgcgtgagtaacctgcccataagagggggataatccttggaaacggggactaataccgcatatagtaattttaccgcatggtttaattatgaaagattta

SEQ ID NO: 1088 - DNA, 225 bp, Unknown
  Encodes 16S rRNA from Lactobacillus
agagtttgatcctggctcaggatgaacgccggcggtgtgcctaatacatgcaagtcgaacgcgttggcccaactgattgaacgtgcttgcacggacttgacgttggtttaccagcgagtggcggacgggtgagtaacacgtaggtaacctgccccaaagcgggggataacatttggaaacagatgctaataccgcataacaatttgaatcgcatgattcaaattt

SEQ ID NO: 1089 - DNA, 225 bp, Unknown
  Encodes 16S rRNA from Clostridium IV
agagtttgatcatggctcaggacgaacgctggcggcgtgcttaacacatgcaagtcgaacgagaatcagtggaaagagttttcggacgatggaagctgaggaaagtggcggacgggtgagtaacgcgtgaggaacctgccttggagagggggacaacagccggaaacggctgctaataccgcatgacatatctgaatcgcatggtttggatatcaaagaattatc

SEQ ID NO: 1090 - DNA, 225 bp, Unknown
  Encodes 16S rRNA from Prevotella
agagtttgatcatggctcaggatgaacgctagctacaggcttaacacatgcaagtcgaggggcatcgggagggaagcttgctttccttgccggcgaccggcgcacgggtgagtaacgcgtatccaacctgccgcacagtaggggatagcccggagaaatccggattaataccctatgttctccgagtcagtcatctgaattggagcaaaggttcgccgctgtgcg

SEQ ID NO: 1091 - DNA, 225 bp, Unknown
  Encodes 16S rRNA from Bifidobacterium
agagtttgatcatggctcaggatgaacgctggcggcgtgcttaacacatgcaagtcgaacgggatcctgcgggctttgcttgcgggtgagagtggcgaacgggtgagtaatgcgtgaccaacctgccccatgctccggaatagctcctggaaacgggtggtaatgccggatgctcccgcgccccgcatggggtgtggggaaagctttcgtggcatgggatggggt

SEQ ID NO: 1092 - DNA, 225 bp, Unknown
  Encodes 16S rRNA from Adhaeribacter
agagtttgatcctggctcaggatgaacgctggcggcaggcttaatacatgcaagtcgaacggtaaggcccgaggtagcaataccgagggtacacgagtggcgcacgggtgcgtaacgcgtatgtaatctgcccctgaccggaacaaaacagctggaaacggctgctaatattccatggccatcttcccgggcatccgggaggatgtaaagattcattggtcgggg

SEQ ID NO: 1093 - DNA, 225 bp, Unknown
  Encodes 16S rRNA from Hydrogenoanaerobacterium
agagtttgatcatggctcaggagaaacgctggcggcgcacataagacatgcaagtcgaacggaatttagccgaatgtttacatgaggcgaagatttagtggcggacgggtgagtaacacgtgagcaacctaccttggagagggggataacattgagaaatcagtgctaataccgcataaaactaatttattgcatgatagattagtcaaaggagaaatccgctct

SEQ ID NO: 1094 - DNA, 225 bp, Unknown
  Encodes 16S rRNA from Acetivibrio
agagtttgatcctggctcaggacgaacgctggcggcgtgcttaacacatgcaagtcgaacgggacttcagggaacgaggcttcggccaagcgaactgaagtttagtggcggacgggtgagtaacgcgtgagtaacctgcctatcacagggggacaacagttggaaacgactgctaataccgcataacgtattttcggggcatcccggggataccaaaggagcaat

SEQ ID NO: 1095 - DNA, 225 bp, Unknown
  Encodes 16S rRNA from unknown taxa
agagtttgatcctggctcaggatgaacgctggcggcgtgcttcatacatgcaagtcgaacgagaaatggcagcttgctgccatggaaagtggcggacgggtgagtaatacatagggaatctgcccctagccgggggacaacagttggaaacgactgctaataccgcatatgagatagattgaaatatttatcttgaaaactccggtggctagggatgagcctgtg

SEQ ID NO: 1096 - DNA, 225 bp, Unknown
  Encodes 16S rRNA from Flammeovirga
agagtttgatcatggctcaggatgaacgctagcggcaggccttatacatgcaagtcgaggggtaacatggtgtagcaatacattgatgacgaccggcgtatgggtgagtaatacgtacgtaatctacctcatatagaagaataactcctagaaatgggaactaatgcttcatacagttttaaaaggaatcttttaaaatgaaagatttatcgatatgggatgagc

SEQ ID NO: 1097 - DNA, 225 bp, Unknown
  Encodes 16S rRNA from Dethiosulfovibrio
agagtttgatcatggctcaggatgaacgctggcggcgtgcttaacacattcaagtcgaacggagtattatcgggagcttgcttttgataatacttagtggcggacgggtgagtaatacatgagcaacctgcctttaagagggggataacacagagaaatttgtgctaataccgcatagaacactgagatggcatcatcatagtgggaaaggagcaatccgcttaa

SEQ ID NO: 1098 - DNA, 225 bp, Unknown
  Encodes 16S rRNA from Hippea
agagtttgatcctggctcaggacgaacgctggcggcgtgcctaacacatgcaagtcgagcgaattcttacagagtatcgtaagagttagcggcaaacgggtgagtaacacatgggaaacctcccttagaatggggaacatctccgtgaaaacggagctaataccgcataagaccacagtttggcatcaaacaggggtaaaagcagcaatgcgttctaagatggtc

SEQ ID NO: 1099 - DNA, 225 bp, Unknown
  Encodes 16S rRNA from Faecalibacterium
agagtttgatcctggctcaggataaacgctggcggcgcacataagacatgcaagtcgaacggacgaagttagaatctttacgtttttaactaagttagtggcggactggtgagtaacgcgtgaataacctacctattagaggggaataacgaagagaaattttcgctaataccgcataagctgataggaccgcatggtctagtcagaaaaggagtaatccgctaa

SEQ ID NO: 1100 - DNA, 225 bp, Unknown
  Encodes 16S rRNA from Spirochaeta
agagtttgatcatggctcagaacgaacgctggcggcgcgttttaagcatgcaagtcgcagggtaaaattttagcaatagaattgagactggcgaacgggtgagtaacacgtgaaaatctaccttgagatgggggatagccggtagaaatatcgggtaataccgcatatgccgagaggtgaaaggggcaactgctccgtcttgagatgagtttgcgtctgattaga

SEQ ID NO: 1101 - DNA, 225 bp, Unknown
  Encodes 16S rRNA from Brevundimonas
agagtttgatcatggctcagaatgaacgctggcggtatgcttaatacatgcaagtcgaacgagaaagttcagcaatggacgagtaaagtggcgtacgggtgagtaatatataggaatctacccagtaatgaggaataagcactggaaacggtgtctaataccacatactaccatttatttgggaaagggttaatggcaacattaacctgttattggatgagccta

SEQ ID NO: 1102 - DNA, 225 bp, Unknown
  Encodes 16S rRNA from Mucilaginibacter
agagtttgatcatggctcaggatgaacgctagcggcaggcctaatacatgcaagtcgaacgggatgggctccttcgggggccctgagagtggcgcacgggtgcgcaacgcgtatgcaaccaacccccgacaggcggatagccggtggaaacgccggataatacgccatggttccgtgggagggcatcctcctgaggataaagccgagaggcggtcggggacgggc

SEQ ID NO: 1103 - DNA, 225 bp, Unknown
  Encodes 16S rRNA from Hydrogenoanaerobacterium
agagtttgatcatggctcaggacgaacgctggcggcgcgcctaacacatgcaagtcgaacggaactagtgaccggagggtagagggatctatcttgcgatcactagttcagtggcggacgggtgagtaaaacatgagcaacctggctagtagagggggatagcttttggaaacagaagataataccgcatacatcagagatttcgcatgaagtttttggaaaagg

SEQ ID NO: 1104 - DNA, 225 bp, Unknown
  Encodes 16S rRNA from Asaccharobacter
agagtttgatcctggctcaggatgaacgctggcggcgtgcctaacacatgcaagtcgaacggttaacccgccttcgggcggtcataaagtggcgaacgggtgagtaacacgtgaccaacctgccccgcgctccgggacagcctcgcgaaagcgggattaataccggatgcaccgcacctttcgcatgatcggtgcgggaaagctccggcggcgcgggatggggtc

SEQ ID NO: 1105 - DNA, 225 bp, Unknown
  Encodes 16S rRNA from Clostridium IV
agagtttgatcctggctcaggatgaacgctggcggcgtgcataacacattcaagtcgaacgaagcatgtagacggaagttttcggatggaagtatatatgacttagtggcggacgggtgagtaacgcgtgagcaaccttcctgcctgtgagggataacacagggaaacttgtgctaataccgcatgacgcacagacatcgcatggtgagtgtgccaaagatttat

SEQ ID NO: 1106 - DNA, 225 bp, Unknown
  Encodes 16S rRNA from Mogibacterium
agagtttgatcatggctcaggatgaacgctggcggcgtgcctaatacatgcaagtcgagcgagaagccaatttgaagcgttttcggacaattctgtttggtggaaagcggcggacgggtgagtaacgcgtaggcaacctgcccttagcagagggatagccattggaaacgatgattaaaacctcataatgccggttttacacatgttggaccggccaaagattta

SEQ ID NO: 1107 - DNA, 225 bp, Unknown
  Encodes 16S rRNA from Clostridium IV
agagtttgatcctggctcaggacgaacgctggcggcgtgcctaacacatgcaagtcgaacggagttattagagtgaagttttcggatggagcgaagataacttagtggcggacgggtgagtaacgcgtgagtaacctgcccattagagggggataacgttctgaaaagaacgctaataccgcataatatatttagttcgcatgaactgaatatcaaaggagcaat

SEQ ID NO: 1108 - DNA, 225 bp, Unknown
  Encodes 16S rRNA from Oscillibacter
agagtttgatcatggctcaggacgaacgctggcggcgtgcctaacacatgcaagtcgaacgaagctccggaagggcgacttcggtcaaacggaaggaagacttagtggcgaacgggtgagtaacgcgtgaggaacctgcctttcagtgggggacaacagttggaaacgactgctaataccgcataacgtacggaggtcgcatgaccattgtaccaaagatttatt

SEQ ID NO: 1109 - DNA, 225 bp, Unknown
  Encodes 16S rRNA from Clostridium XlVa
agagtttgatcatggctcaggatgaacgctggcggcgtgcctaacacatgcaagtcgagcggagagacagcggagattcaatcgatgatctgcttcttcttagcggcggatgggtgagtaacacgtgggtaacctgccctgcactgggggataacagttggaaacgactgttaataccgcatatgcgcacgggaccgcatggtcctgggcggaaagatttatcgg

SEQ ID NO: 1110 - DNA, 225 bp, Unknown
  Encodes 16S rRNA from Faecalibacterium
agagtttgatcctggctcaggacgaacgctggcggcatgcctaacacatgcaagtcgaacggtctaagagataaatttttaatttatttcaaggatagtggcgaacgggtgagtaacgcgtgagcaacctaccttttagagggggataacgcttggaaacaggcgctaataccgcataagctccgagtattgagtgatacaaggagaaaaggaggaatccgctaa

SEQ ID NO: 1111 - DNA, 225 bp, Unknown
  Encodes 16S rRNA from Altererythrobacter
agagtttgatcctggctcagaacgaacgctggcggcatgcttaacacatgcaagtcgaacggtgttttctagtacttgtattaggaaacatagtggcaaacgggtgagtaacgcgtgggaatgtacccttaagtattggataacgtctggaaacggacgctaatacaatatacgctcgagagaggaaagagagatcgctgaaggagtagcccgcgttagattagg

SEQ ID NO: 1112 - DNA, 225 bp, Unknown
  Encodes 16S rRNA from Gelidibacter
agagtttgatcctggctcaggataaacgctagcggcaggcctaacacatgcaagtcgagcggtaacgggagtagcaatacttgccgacgagcggcggacgggtgagtaacgcgtatgcaacctaccctttattcagggatagccttccgaaaggaggattaatacctgatggttcatttgagaggcatcttgataatgataaagatttattgataaaggatgggc

SEQ ID NO: 1113 - DNA, 225 bp, Unknown
  Encodes 16S rRNA from Prevotella
agagtttgatcatggctcaggatgaacgctagctacaggcttaacacatgcaagtcgaggggcatcacgggattggtttcggccattcctggtggcgaccggcgcacgggtgagtaacgcgtatccaacctgcccgcaaccgcggaatagcccgccgaaaggcggattaatgccgcatgcgctcgcgcgctggcatctgatcgcgagcaaaggtttttccggttg

SEQ ID NO: 1114 - DNA, 225 bp, Unknown
  Encodes 16S rRNA from Anaerovorax
agagtttgatcatggctcaggatgaacgctggcggcgtgcctaacacatgcaagtcgagcgagaatctttgaagtagcttgctacggagaagaggacagcggcggacgggtgagtaacgcgtaggtaagctgccccttgcagaaggatagcctcgggaaactgggattaatacttcataaagcgttttcatcgcatggtgagaacgccaaagatctatcggcaag

SEQ ID NO: 1115 - DNA, 225 bp, Unknown
  Encodes 16S rRNA from Riemerella
agagtttgatcatggctcaggatgaacgctagcgggaggcctaacacatgcaagccgagcggtagaaagtagcttgctacttttgagagcggcgtacgggtgcggaacacgtgtgcaacctgcctttatctggggaatagcctttcgaaaggaagattaatgccccataacatattgattggcatcaattaatattgaaagctccggcggatagagatgggcacg

SEQ ID NO: 1116 - DNA, 225 bp, Unknown
  Encodes 16S rRNA from Sphingobacterium
agagtttgatcatggctcaggatgaacgctagcggcaggcctaatacatgcaagtcgaacgggatctactggtaagcttgcttattggtagtgagagtggcgcacgggtgcgtaacgcgtgagcaacctacccttgtcagggggatagcccggcgaaagtcggattaataccgcatgacatcattgagaggcatctttcggtgatcaaagatttatcggacaagg

SEQ ID NO: 1117 - DNA, 225 bp, Unknown
  Encodes 16S rRNA from Syntrophococcus
agagtttgatcatggctcaggatgaacgctggcggcgtgcctaacacatgcaagtcgaacgaggctctgatccccgatgattcgtctgaagggaaaggatgtccgagtggcggatgggtgagtaacgcgtggagaacctgccccctgctgggggataacaactggaaacggttgacaataccgcataagcgcttttgatcgcatgatctgaagcggaaagattta

SEQ ID NO: 1118 - DNA, 225 bp, Unknown
  Encodes 16S rRNA from Bacteroides
agagtttgatcatggctcaggatgaacgctagctacaggcttaacacatgcaagtcgaggggcatcgcggtgtagcaatacactggcggcgaccggcgcacgggtgagtaacacgtatccaacctgccttcagctcggggatagccctctgaaaggaggattaatacccgatgtggtttttcgcagacatctgcgtataattaaagatttatcggctgatgatgg

SEQ ID NO: 1119 - DNA, 225 bp, Unknown
  Encodes 16S rRNA from Papillibacter
agagtttgatcctggctcaggatgaacgctggcggcgtgcataacacattcaagtcgaacgaagcactttggcggaaccttcgggggaagctgatttgacttagtggcggacgggtgagtaacgcgtgagcaaccttcctgcttgtgagggataacacagggaaacttgtgctaataccgcatgacgcatagacatcgcatggtgactatgccaaagacatgttg

SEQ ID NO: 1120 - DNA, 225 bp, Unknown
  Encodes 16S rRNA from Butyricicoccus
agagtttgatcctggctcaggatgaacgctggcggcgtgcataacacattcaagtcgaacgggacttagagggcttgccctttaagtttagtggcggacgggtgagtaacgcgtgagtaacctacctacatgagagggataacacagggaaacttgtgctaataccacataacatactgaattcgcatgtatttagtatcaaagagcaatcgcatatagatggac

SEQ ID NO: 1121 - DNA, 225 bp, Unknown
  Encodes 16S rRNA from Clostridium IV
agagtttgatcatggctcaggatgaacgctggcggcgtgcctaacacatgcaagtcgaacggactgatttccttcgggaatgaaagttagtggcggacgggtgagtaacgcgtgaggaacctgccttacagagggggataacgataagaaattgtcgctaataccgcataacacctcacacccgcatgggtgaggggtcaaaggagcaatccgctgtaagatggc

SEQ ID NO: 1122 - DNA, 225 bp, Unknown
  Encodes 16S rRNA from Hydrogenoanaerobacterium
agagtttgatcatggctcaggacgaacgctggcggtatgcctaacacatgcaagtcgaacgggtgtgtaaagagcttgctctttatttcactagtggcggacgggtgagtaacgcgtgagtaatctgccttgaagtggggaataacatttggaaacaaatgctaataccgcgtaatatactttcttcgcatgaagtttgtatcatagtttttcgcttcaagatga

SEQ ID NO: 1123 - DNA, 225 bp, Unknown
  Encodes 16S rRNA from Marvinbryantia
agagtttgatcatggctcaggatgaacgctggcggcgtgcctaacacatgcaagtcgaacgaagaccccgaagcggagatttcggttgaagctaagggaggactgagtggcggacgggtgagtaacgcgtggataacctgccccatacagggggatagcagttggaaacgactgataataccgcataagcgcacgaggagacatctccctgtgtgaaaagaatta

SEQ ID NO: 1124 - DNA, 225 bp, Unknown
  Encodes 16S rRNA from Brevibacillus
agagtttgatcatggctcaggatgaacgctggcggcgtgcctaatacatgcaagtcgaacggagaggcctcgacggaaaggtgcttgcaccttgaagatgaggaatcttagtggcgaacgggtgagtaatacatgagcaacctacccctttgactgggataacattctgaaaaggatgctaataccggataattaatattgaggcatctcgatattattaaaggt

SEQ ID NO: 1125 - DNA, 225 bp, Unknown
  Encodes 16S rRNA from Clostridium IV
agagtttgatcctggctcaggataaacgctggcggcgtgcataacacattcaagtcgaacgaagcactttttcttgagacttcggtcaagagaggatttgacttagtggcggacgggtgagtaacgcgtgagcaacctgcctaccggtgcgggataacgtttggaaacggacgctaataccgcataacgcatagatatcgcatggtatttgtgccaaagattcat

SEQ ID NO: 1126 - DNA, 225 bp, Unknown
  Encodes 16S rRNA from Prevotella
agagtttgatcatggctcaggatgaacgctagcggcaggcttaacacatgcaagtcgaggggcatcgcggggtagcaatactctggcggcgaccggcgaaagggtgagtaacgcgtgagcaacatgcccttgggtgggggatagtcattggaaacgatgcgtaataccccgtacgacgagagaccgcatgatttttcgttaatagatttattgcccaaggattgg

SEQ ID NO: 1127 - DNA, 225 bp, Unknown
  Encodes 16S rRNA from Clostridium IV
agagtttgatcatggctcaggatgaacgctggcggcgtgcctaacacatgcaagtcgaacggaacttgagggcttgcccttaagtttagtggcggacgggtgagtaacgcgtgagtaacctgcctttgagaggggaataacttcccgaaagggatgctaataccgcataacacatagctgtcgcatggcagagatgtcaaagattttatcgctcaaagatggact

SEQ ID NO: 1128 - DNA, 225 bp, Unknown
  Encodes 16S rRNA from Aminobacter
agagtttgatcctggctcagaacgaacgctggcggcaggcttaacacatgcaagtcgagcgccccgcaaggggagcggcagacgggtgagtaacgcgtgggaatctaccttttgctacggaataactcagggaaacttgtgctaataccgtatgtgtccttcgggagaaagatttatcggcaagagatgagcccgcgttggattagctagttggtggggtaaagg

SEQ ID NO: 1129 - DNA, 225 bp, Unknown
  Encodes 16S rRNA from Sporotomaculum
agagtttgatcatggctcaggacgaacgctggcggcgtgcttaacacatgcaagtcgaacgggcgacccttctacggaaggggagctagtggcggacgggtgagtaacgcgtgagcaaccaacccataagagggggataacaacgggaaaccgttgctaataccgcataagaccaagacagcgcatgctgaaggggtcaaaggagtaatccgcttatggacgggc

SEQ ID NO: 1130 - DNA, 225 bp, Unknown
  Encodes 16S rRNA from Clostridium IV
agagtttgatcatggctcaggacgaacgctggcggcgcgcctaacacatgcaagtcgaacggagagcgtgttttgaattcttcggaaggaaagatacgtttcttagtggcggacgggtgagtaacacgtgagcaacctgccttgcagagagggataacgattggaaacgatcgctaataccacataacatatggatatcgcatggtgaccatatcaaagatttat

SEQ ID NO: 1131 - DNA, 225 bp, Unknown
  Encodes 16S rRNA from Pedobacter
agagtttgatcctggctcaggatgaacgctagcggcaggcctaacacatgcaagtcgaggggcagcgcggggtagcaataccctggcggcgaccggcggatgggtgcgtaacgcgtatgcaacctgcctcggacaggaggataaccctgggaagctgggactaatactccgtatgacgagacctcgcatggggtcttgttgaaagccttggtggtccgagatggg

SEQ ID NO: 1132 - DNA, 225 bp, Unknown
  Encodes 16S rRNA from Victivallis
agagtttgatcatggctcagaatgaacgctggcggcatggattaggcatgcaagtcgaacggggcgcagcgatgcgcccagtggcgaaagggtgagtagcacgtgaagaacctgcccccggatccggaacaagcgctggaaacggcgtctgatacgggatgtggacgcggcccgcatgggccgcgctctaaagattcatcgtccggggagggcttcgcgtcccat

SEQ ID NO: 1133 - DNA, 225 bp, Unknown
  Encodes 16S rRNA from Gelidibacter
agagtttgatcatggctcaggataaacgctagcggcaggcctaacacatgcaagtcgagcggtaacgggagtagcaatacttgccgacgagcggcggacgggtgagtaacgcgtatgcaacctaccctttattcagggatagccttccgaaaggaggattaatacctgatagtactcaatgagggcatccaaagtgagttaaagatttattgataaaggatgggc

SEQ ID NO: 1134 - DNA, 225 bp, Unknown
  Encodes 16S rRNA from Prevotella
agagtttgatcatggctcaggatgaacgctagctacaggcttaacacatgcaagtcgaggggcagcatggctgttgcttgcaacagccgatggcgaccggcgcacgggtgagtaacgcgtatccaacctgccccataccgcggcacagcccggagaaatccggattaactccgcatgcggtcctttgatggcatcagtttaggaccaaacgttcagggtatggga

SEQ ID NO: 1135 - DNA, 225 bp, Unknown
  Encodes 16S rRNA from Wautersiella
agagtttgatcctggctcaggatgaacgctagcgggaggcttaacacatgcaagccgaggggtagagatagcttgctattttgagaccggcgcacgggtgcgtaacgcgtatgcaacttgccctattgaaagggatagcccagagaaatttggattaataccttataataaatttcattgcatgatgagattttgaaagatttatcgcagtaggataggcatgcg

SEQ ID NO: 1136 - DNA, 225 bp, Unknown
  Encodes 16S rRNA from Slackia
agagtttgatcctggctcaggatgaacgctggcggcgtgcctaacacatgcaagtcgaacggttaaaccggcttttagccggacataaagtggcgaacgggtgagtaacacgtgaccaacctgccccccgcaccgggacaacgggcggaaacgcccgctaataccggatactccgggcgccggcgcatgccggccccgggaaagcccaggcggcgggggatgggg

SEQ ID NO: 1137 - DNA, 225 bp, Unknown
  Encodes 16S rRNA from Pyramidobacter
agagtttgatcctggctcaggacgaacgctggcggcgtgcttaacacatgcaagttgggcgaggatggtttgaggagacatatgttgaattgaatcgttcgagcagcggacgggtgagtaaagcacaaggacttgtccgaaagagagggacaccttcgggaaaccggagctaatacctcataagccggaaggtgaaaagcagagatgcgcttttggagagacttg

SEQ ID NO: 1138 - DNA, 225 bp, Unknown
  Encodes 16S rRNA from Lachnospiracea incertae sedis
agagtttgatcatggctcaggatgaacgctggcggcgtgcttaacacatgcaagtcgaacggactttgctcgctgaaaaaggaaggtgcttgcacctgagagtttcttgaggaaagttagtggcggacgggtgagtaacgcgtgggtaacctgcctatcacagggggataacagttggaaacgactgctaataccgcataagcgcacggtatcgcatgatacagt

SEQ ID NO: 1139 - DNA, 225 bp, Unknown
  Encodes 16S rRNA from Clostridium XlVa
agagtttgatcctggctcaggatgaacgctggcggcgtgcttaacacatgcaagtcgaacggggtacagacgctgaagagtggagtgcttgcacaaagcgattcttgtttgtacctagtggcggacgggtgagtaacgcgtgggtaacctgccatacacagggggacaacagttggaaacgactgctaataccgcatatgcacacagtgaggcatctcacagggt

SEQ ID NO: 1140 - DNA, 225 bp, Unknown
  Encodes 16S rRNA from Prevotella
agagtttgatcatggctcaggatgaacgctagctacaggcttaacacatgcaagtcggggggcagcacgggaagcagcaatgcttttgggtggcgaccggcgaatgggtgagtaacgagtatccaacctgccccgtgctccgggacagccccgcgaaagcgggattaataccggatggtgcgtatgttccgcatgggatatacgtcaaagattcatcggcacggg

SEQ ID NO: 1141 - DNA, 225 bp, Unknown
  Encodes 16S rRNA from Lentisphaera
agagtttgatcctggctcagaatgaacgctggcggcatggattaggcatgcaagtcgaacgccccgggcttgcccggggagtggcgaaagggtgcgcaacgcgtggggaacccgcccccgggcccgggacaagcgctggaaacggcgtctgatacgggatgtcgagccgggccgcatggcccggcgtcgaaagattcatcgcccggggagggccccgcgtcccat

SEQ ID NO: 1142 - DNA, 225 bp, Unknown
  Encodes 16S rRNA from Desulfoluna
agagtttgatcatggctcagaatgaacgctggcggcgtgcctcaggcatgcaagtcgaacgagaaagttccttcggggatgagtatagtggcgcacgggtgagtaatacttaggtaacgtaccttttcgctggggatagctaggggaaactttagataataccgaatatatccatttttactgcggtttaaatggagaaagccgtaaggcgcgaagagagcggcc

SEQ ID NO: 1143 - DNA, 225 bp, Unknown
  Encodes 16S rRNA from Clostridium III
agagtttgatcctggctcaggacgaacgctggcggcgtgcttcatacatgcaagtcgaacgagaatctctggcttgccagagaggaaagtggcggacgggtgagtaatatgtagagaatctgccctagagagtgggacaacagagggaaacttctgctaataccgcatatgcgcgtagctgagatgctattcgtgaaaactccggtgctctgggatgagtctgca

SEQ ID NO: 1144 - DNA, 225 bp, Unknown
  Encodes 16S rRNA from Clostridium sensu stricto
agagtttgatcatggctcaggacgaacgctggcggcgcgcctaacacatgcaagtcgaacgggactagtgactggagctaagaagttttcttggttgcattcactagttcagtggcggacgggtgagtaaagcatgagtaacttgcccattagtggggaatagcttttggaaacagaagataataccgcatacatcggtttggacacatgttcggaccggaaaag

SEQ ID NO: 1145 - DNA, 225 bp, Unknown
  Encodes 16S rRNA from Prevotella
agagtttgatcctggctcaggatgaacgctagctacaggcttaacacatgcaagtcgaggggcagcacggggactgcttgcagttcccggtggcgaccggcgcacgggtgagtaacgcgtatccaacctgcccgcaactgcggaatagcccgccgaaaggcggattaatgccgcatgagctcgcgcgagggcatcatttcgcgagcaaaggttcattccggttgc

SEQ ID NO: 1146 - DNA, 225 bp, Unknown
  Encodes 16S rRNA from Clostridium III
agagtttgatcatggctcaggacgaacgctggcggcgtgcctaacacatgcaagtcgaacggagttattgcgattgatcccttcggggtgacgttgttctaacttagtggcggacgggcgagtaacgcgtgaataacctgcccataagaggggaataatccatggaaacgtggactaataccgcatattgtaattttatcgcatggtttaattatgaaagattta

SEQ ID NO: 1147 - DNA, 225 bp, Unknown
  Encodes 16S rRNA from Clostridium IV
agagtttgatcatggctcaggatgaacgctggcggcgtgcataacacattcaagtcgaacgaagcactgacgatgaagtcttcggatggaattgtctttgacttagtggcggacgggtgagtaacgcgtgagcaaccttcctggcagtgagggataacacagggaaacttgtgctaataccgcatgacgcacgggaatcgcatggttttagtgccaaagatttat

SEQ ID NO: 1148 - DNA, 225 bp, Unknown
  Encodes 16S rRNA from Prevotella
agagtttgatcatggctcaggatgaacgctagctacaggcctaacacatgcaagtcgaggggcagcatgagggtagctcgctacctttgatggcgaccggcgaatgggtgagtcacgcgtgtccaacctgcctccggcccggggatagcccttggaaatgaggattaagacccgataggtggcgcttccgcatggcggcgccatgaaactggaccggagatgggg

SEQ ID NO: 1149 - DNA, 225 bp, Unknown
  Encodes 16S rRNA from unknown taxa
agagtttgatcctggctcaggacaaacgctggcggcgtgcctaatacatgcaagtcgaacgagaatcaggagcttgctcctgaggaaagtggcggacgggtgagtaatatgtaggaaatctgcccttaggagggggacaacagttggaaacgactgctaataccccatatgagcgtagctgaaatgctattcttgaaatgatttttcgcctaaggatgagcctgc

SEQ ID NO: 1150 - DNA, 225 bp, Unknown
  Encodes 16S rRNA from Helicobacter
agagtttgatcatggctcagagttaacgctggcggcgtgcctaacacatgcaagtcgagcgaattcttacagagtatcgtaagagttagcggcaaacgggtgagtaacacatgggaaaccttccttagaaaggggaacacctccgtgaaaacggagttaataccgcataagaccacagtttggcatcgaacaggggtaaaagcagcaatgcgttctaagatggtc

SEQ ID NO: 1151 - DNA, 225 bp, Unknown
  Encodes 16S rRNA from Clostridium XlVa
agagtttgatcctggctcaggatgaacgctggcggcgtgcttaacacatgcaagtcgaacggagataagctctgatgaagcttcggcagaatcttgcttatcttagtggcggacgggtgagtaacgcgtgggtaacctacctgcaacagggggataacgattggaaacgatcgctaataccgcataacccgctagagtcgcatgactcagacggaaaagatttat

SEQ ID NO: 1152 - DNA, 225 bp, Unknown
  Encodes 16S rRNA from Coprococcus
agagtttgatcctggctcaggatgaacgctggcggcgtgcttaacacatgcaagtcgaacggagtttagcgcttccaaagcttcggcagaggattgttaaacttagtggcggacgggtgagtaacgcgtgggtaacctgccatatacagggggataacacttagaaataggtgctaataccgcataagcgcacggcatcgcatgatgccgtgtgaaaaactccgg

SEQ ID NO: 1153 - DNA, 225 bp, Unknown
  Encodes 16S rRNA from Bradyrhizobium
agagtttgatcatggctcagaacgaacgctggcggcacgcctaacacatgcaagtcggacggtatggatagcttgctattcatatagtggcggactggtgagtaatatgtaggaatctgcccataggttagggatagcaccgggaaactggtggtaatacctgatatcctggagacaggaaaggagcaattcgccgatggaggagcctatatctgattagatagt

SEQ ID NO: 1154 - DNA, 225 bp, Unknown
  Encodes 16S rRNA from Clostridium IV
agagtttgatcctggctcaggacgaacgctggcggcgtgcctaacacatgcaagtcgagcggacttataaatagaaggtgcttgcactggaaatttacaagttagcggcggacgggtgagtaacgcgtgagcaacctgtcctctacagggggataagatttcgaaagggattctaataccgcatgagaccacagcagggcatcctgcgggggtcaaaggaggaat

SEQ ID NO: 1155 - DNA, 225 bp, Unknown
  Encodes 16S rRNA from Sphingobacterium
agagtttgatcatggctcaggatgaacgctagcggcaggcctaatacatgcaagtcggacgggatccattgatagcttgctatccatggtgagagtggcgcacgggtgcgtaacgcgtgagcaacctacctccatcagggggatagcctctcgaaagagagattaacaccgcataacataatgttccggcatcgggatattattaaatatttataggatggagat

SEQ ID NO: 1156 - DNA, 225 bp, Unknown
  Encodes 16S rRNA from Gelidibacter
agagtttgatcatggctcaggataaacgctagcggcaggcctaacacatgcaagtcgagcggcatcgggagtggcaacacttgccggcgagcggcggacgggtgagtaacgcgtatgcaacctgcccaccacacggagatagccgaccgaaaggacgattaaactccgatggcaccttctgggggcatccccgaaaggttaaatattcataggtggtggatgggc

SEQ ID NO: 1157 - DNA, 225 bp, Unknown
  Encodes 16S rRNA from Vasilyevaea
agagtttgatcatggctcagaacgaacgctggcggcaggcttaacacatgcaagtcgaacgccccgcaaggggagtggcagacgggtgagtaacgcgtgggaatctacccagttctacggaacaactgagggaaacttcagctaataccgtatacgccctacgggggaaagatttatcggaattggatgagcccgcgttggattagctagttggtggggtaatgg

SEQ ID NO: 1158 - DNA, 225 bp, Unknown
  Encodes 16S rRNA from Eubacterium
agagtttgatcatggctcaggacgaacgctggcggcgtgcttaacacatgcaagtcgaacgaagcttgattaatgaattcttcggaatgatttatgatatgactgagtggcggacgggtgagtaacgcgtgagtaacctgcctcttggagggggatagtgtttggaaacgaacagtaataccgcataacgtgcattgatggcatcatcgatgtaccaaagattta

SEQ ID NO: 1159 - DNA, 225 bp, Unknown
  Encodes 16S rRNA from Clostridium XlVa
agagtttgatcatggctcaggatgaacgctggcggcgtgcttaatacatgcaagtcgaacgagcagagatattcgtatcaaagcgagtggcggacgggtgagtaacgcgtgggaaacctgccctataccgggggataacagttggaaacgactgctaataccgcataagcgcacgatgtcgcatgacattgtgcgaaaaactccggtggtataggatggtcccgc

SEQ ID NO: 1160 - DNA, 225 bp, Unknown
  Encodes 16S rRNA from Eubacterium
agagtttgatcctggctcaggacgaacgctggcggcgtgcttaacacatgcaagtcgaacgaagcttgaagatagatttcttcggaatgacatctgatatgactgagtggcggacgggtgagtaacgcgtgagcaacctgcccttcggagggggatagcgtttggaaacgaacggtaataccgcataatgttaacggaaggcatcttctgttaaccaaaactccg

SEQ ID NO: 1161 - DNA, 225 bp, Unknown
  Encodes 16S rRNA from Syntrophococcus
agagtttgatcatggctcaggatgaacgctggcggcgtgcctaacacatgcaagtcgaacgggaactccgatctgaaggttcgctggatgattggaaattctagtggcggacgggtgagtaacgcgtgggtaacctgccctttagagggagataacagagagaaatttctgataatatcccatatgcttacagcttcgcatgaagcagtgaggaaagaatttcgc

SEQ ID NO: 1162 - DNA, 225 bp, Unknown
  Encodes 16S rRNA from Prevotella
agagtttgatcatggctcaggatgaacgctagctacaggcttaacacatgcaagtcgaggggcagcatgtaggttgcttgcaacctatgatggcgaccggcgcacgggtgcgtaacgcgtatccaaccttccccgcagtagggtgcagcccgttgaaagacggattaatcccctatgttgtccattgacggcatccgatttggacgaaaggtttcaccgctgcgg

SEQ ID NO: 1163 - DNA, 225 bp, Unknown
  Encodes 16S rRNA from Treponema
agagtttgatcctggctcagaacgaacgctggcggcgcgtcttaagcatgcaagtcggacggcaagattggtgcttgcactgatcctagagtggcggactggtgagtaacgcgtgggtgacgtaccctccggacggggatagctactagaaatagtagataataccggatacggtgcactgtgtcagaggcagtgcaggaaaggttcttttgaaccgccggggga

SEQ ID NO: 1164 - DNA, 225 bp, Unknown
  Encodes 16S rRNA from Anaerovorax
agagtttgatcatggctcaggatgaacgctggcggcgtgcctaacacatgcaagtcgagcgagaagctttccagaagatacttcggttgattcagggaagtggaaagcggcggacgggtgagtaacgcgtaggcaacctgccccttgcagagggatagcctcgggaaaccgggattaaaacctcataatgcggtgagaagacatcttcatatcgccaaagattta

SEQ ID NO: 1165 - DNA, 225 bp, Unknown
  Encodes 16S rRNA from Erysipelotrichaceae incertae sedis
agagtttgatcctggctcaggatgaacgctggcggcatgcctaatacatgcaagtcgaacggagcctttcggggctcagtggcgaacgggtgagtaacacgtaggtaacctgcccatgtgcccgggacaacagctggaaacggctgctaaaaccggataggtatcgaggaggcatctcctggatattaaaggggctttcgggccctgaacatggatggacctgcg

SEQ ID NO: 1166 - DNA, 225 bp, Unknown
  Encodes 16S rRNA from Sulfurovum
agagtttgatcatggctcagagtgaacgctggcggcgtgcttaacacatgcaagtcgaacgagaacggtccttcgggatgtcagctaagtggcggacgggtgagtaatgtatagttaatctgccctttagagggggataacagttggaaacgactgctaataccccatactccttttaccttaatggtaattgggaaacgttttttcgctaaaggatgagactat

SEQ ID NO: 1167 - DNA, 225 bp, Unknown
  Encodes 16S rRNA from Clostridium IV
agagtttgatcatggctcaggagaaacgctggcggcgcacataagacatgcaagtcgaacggaatttagccaaatgtttacatgaggcgaaaatttagtggcggacgggtgagtaacacgtgagcaacctgcctttaagagggggataacattgagaaatcagtgctaataccgcataaagcatatccaccgcatgatggatataagccaaaggagaaatccgct

SEQ ID NO: 1168 - DNA, 225 bp, Unknown
  Encodes 16S rRNA from Papillibacter
agagtttgatcatggctcaggatgaacgctggcggcgtgcataacacattcaagtcgaacgaagcactttggttggagacttcggtcaaagaccgatttgacttagtggcggacgggtgagtaacgcgtgagcaacctgccttgaagagggggataacacagggaaacttgtgctaataccgcataacgtacgtggatcgcatggttcgtgtaccaaagccttta

SEQ ID NO: 1169 - DNA, 225 bp, Unknown
  Encodes 16S rRNA from Paracoccus
agagtttgatcatggctcagaacgaacgctggcggcaggcctaacacatgcaagtcgagcgcaccttcgggtgagcggcggacgggtgagtaacgcgtgggaatatgcccttctctacggaatagtctcgggaaactgggggtaataccgtatacgccctacgggggaaagatttatcggagaaggattagcccgcgttggattaggtagttggtggggtaacgg

SEQ ID NO: 1170 - DNA, 225 bp, Unknown
  Encodes 16S rRNA from Hydrogenoanaerobacterium
agagtttgatcatggctcaggacgaacgctggcggcgcgcctaacacatgcaagtcgaacggaactagtgaccggagggtagaaaacttctatcttgcgatcactagttcagtggcggacgggtgagtaaaacatgagcaacctggctagtagagggggatagcttttggaaacagaagataataccgcatacatcagagatttcgcatgaagtttttggaaaag

SEQ ID NO: 1171 - DNA, 225 bp, Unknown
  Encodes 16S rRNA from Adhaeribacter
agagtttgatcatggctcaggatgaacgctggcggcaggcttaatacatgcaagtcgaacggtaacgaccggtagcaatactggggcgacgagtggcgcacgggtgcgtaacgcgtatgcaacctaccctcaaccggggcataacgccgagaaattggcgctaatatcccatgtgtatatggagtggcatctctccatatataaagatccgttggttaaggatgg

SEQ ID NO: 1172 - DNA, 225 bp, Unknown
  Encodes 16S rRNA from Lachnospiracea incertae sedis
agagtttgatcatggctcaggatgaacgctggcggcgcgcttaacacatgcaagtcgaacgagatgagtgacttcggtcatgagtctagtggcggacgggtgagtaacgcgtggacaacttgccttatagtgggggatagccgaaagaaatttcgattaataccgcataatacaatttgatcgcatgattggattgggaaaggcttcggtcgctaaaagaaaggt

SEQ ID NO: 1173 - DNA, 225 bp, Unknown
  Encodes 16S rRNA from Bacteroides
agagtttgatcatggctcaggatgaacgctagctacaggcttaacacatgcaagtcgaggggcagcatgggggaggtttcggccacccccgatggcgaccggcgaatgggtgagtaacgcgtatccaacctgcccctgtcccggggacagcccttagaaatgaggattaacccccgatggcgcggattagccgcatggcttttccgccaaatgcgaaggacaggg

SEQ ID NO: 1174 - DNA, 225 bp, Unknown
  Encodes 16S rRNA from Hydrogenoanaerobacterium
agagtttgatcatggctcaggagaaacgctggcggcgcacataagacatgcaagtcgaacggaacttaaattgatgtttacattagcttaagtttagtggcggactggtgagtaacacgtgagcaacctgccctttagaggggaataacattgagaaatcagtgctaataccgcataaagcaacattatcgcatgatgaagttgccaaaggagaaatccgctgaa

SEQ ID NO: 1175 - DNA, 225 bp, Unknown
  Encodes 16S rRNA from Telmatospirillum
agagtttgatcatggctcagaacgaacgctggcggcatgcttaacacatgcaagtcgaacggtgttgttcagtacttgtattgagcaacatagtggcaaacgggtgagtaacgcgtgggaacgtacccaacagtattggataacgtttggaaacgaacgctaatacaatatacgcttgagagaggaaagagagatcgctgatggagcggcccgcgttagattagg

SEQ ID NO: 1176 - DNA, 225 bp, Unknown
  Encodes 16S rRNA from Clostridium XlVa
agagtttgatcatggctcaggatgaacgctggcggcgtgcctaacacatgcaagtcgaacgaagcacttctcccgttgaagcctattagcttgctatgaagcggaaacaattgaagtgacttagtggcggacgggtgagtaacgcgtgggtaacctgccctgtacagggggacaacagctagaaatggctgctaataccgcataagcgcacagcatcgcatggtg

SEQ ID NO: 1177 - DNA, 225 bp, Unknown
  Encodes 16S rRNA from Hydrogenoanaerobacterium
agagtttgatcatggctcaggacgaacgctggcggcacgcttaacacatgcaagtcgaacggaacttgggagcttgctttcaagtttagtggcggacgggtgagtaacacgtgagcaacctgcctttcggcggggaataatgattggaaacgatcactaataccccataaaacagagataccgcatggtaattctgtcaaagattcatcaccgaaagatgggctc

SEQ ID NO: 1178 - DNA, 225 bp, Unknown
  Encodes 16S rRNA from Clostridium IV
agagtttgatcatggctcaggatgaacgctggcggcgtgcataacacattcaagtcgaacgaagcactgacgaggaagtcttcggatggaattgtctttgacttagtggcggacgggtgagtaacgcgtgagcaaccttcctggcagtgagggataacacagggaaacttgtgctaataccgcatgacgcactgagatcgcatggttttagtgccaaagattcat

SEQ ID NO: 1179 - DNA, 225 bp, Unknown
  Encodes 16S rRNA from Vasilyevaea
agagtttgatcctggctcagaacgaacgctggcggcaggcttaacacatgcaagtcgaacgccccgcaaggggagtggcagacgggtgagtaacgcgtgggaatctacccagttctacggaataacccagggaaacttggactaataccgtatacgccctacgggggaaagatttatcggaattggatgagcccgcgttggattagctagttggtggggtaatgg

SEQ ID NO: 1180 - DNA, 225 bp, Unknown
  Encodes 16S rRNA from Anaeroplasma
agagtttgatcatggctcaggattaacgctggcggcgtgcctaatacatgcaagtcgaatggtagtagcaatacaaaccatggcgaacgggtgagtaacacgtaggcaacctgactttaagacgaggataaccgttggaaacgacggataatactggataggacatcacaaagggcatccttagatgtttaaaggttatcatgccacttagagaggggcctgcgg

SEQ ID NO: 1181 - DNA, 225 bp, Unknown
  Encodes 16S rRNA from Sporotomaculum
agagtttgatcctggctcaggacgaacgctggcggcgtgcttaacacatgcaagtcgaacgaggaatgccgaaaagcttgctttttgacatttcgagtggcggacgggtgagtaacgcgtgaggaacctgtcttctacagggggataacgtcccgaaagggacgctaataccgcataagaccacggtgccgcatggcacaggggtcaaaggagcaatccggtgga

SEQ ID NO: 1182 - DNA, 225 bp, Unknown
  Encodes 16S rRNA from Clostridium IV
agagtttgatcctggctcaggatgaacgctggcggcgtgcctaacacatgcaagtcgaacggagcttgagggcttgcccttaagcttagtggcggacgggtgagtaacgcgtgagtaacctgcctttgagaggggaataacttcccgaaagggatgctaataccgcataacacataactgtcgcatggcagaaatgtcaaagattatatcgctcaaagatggact

SEQ ID NO: 1183 - DNA, 225 bp, Unknown
  Encodes 16S rRNA from Enterorhabdus
agagtttgatcatggctcaggatgaacgctggcggcgtgcctaacacatgcaagtcgaacggagaaaccgccctcgggcggagatgaagtggcgaacgggtgagtaacacgtgaccaacctgccccgcgctccgggacagcctcgcgaaagcgggattaataccggatgcgccgcgggccccgcatggggcccgcgggaaagcccaggcggcgcgggatggggtc

SEQ ID NO: 1184 - DNA, 225 bp, Unknown
  Encodes 16S rRNA from Bacteroides
agagtttgatcctggctcaggatgaacgctagctacaggcttaacacatgcaagtcgaggggcagcattaagtcagcttgctgatttagatggcgaccggcgcacgggtgagtaacgcgtatccaacctgccccctacccggggatagccttgcgaaagtaagattaatacccggtgctgttgcgatcccgcatggggatgcaacgaaagattcatcggtagggg

SEQ ID NO: 1185 - DNA, 225 bp, Unknown
  Encodes 16S rRNA from Anaerotruncus
agagtttgatcctggctcaggatgaacgctggcggcgtgcctaacacatgcaagtcgaacgaagctccgatacggaatcttcggaggaagtagaggaagacttagtggcggacgggtgagtaacgcgtgagcaacctgcctttcggagggggataacgattggaaacgatcgctaataccgcataacatatacgtatcgcatggtatgtatatcaaagctgaggc

SEQ ID NO: 1186 - DNA, 225 bp, Unknown
  Encodes 16S rRNA from Rhodopirellula
agagtttgatcatggctcagaatgaacgttggcggcgtggattaggcatgcaagtcgaacggtaaggttacttagcttgctttgtaaccctagagtggcgaaagggatagtacaatgtagatcatataccctcaggttggggatagcgtctggaaacgggcggtaatacccgataacatctccggatcaaaggtgagattccgcctgaggattagtttacacact

SEQ ID NO: 1187 - DNA, 225 bp, Unknown
  Encodes 16S rRNA from Clostridium XlVa
agagtttgatcctggctcaggatgaacgctggcggcgtgcttaatacatgcaagtcgaacgaggaattgtgattgaagttttcggatggatttcacttttccgagtggcggacgggtgagtaacgcgtgggtaacctgccttacacagggggacaacagctggaaacggctgctaataccgcataacccgctagagtcgcatgactcagacggaaaagatttatc

SEQ ID NO: 1188 - DNA, 225 bp, Unknown
  Encodes 16S rRNA from Gelidibacter
agagtttgatcatggctcaggataaacgctagcggcaggcctaacacatgcaagtcgagcggcagcgggagtggcaacacttgccggcgagcggcggacgggtgagtaacgcgtatgcaacctgcccaccacacggagatagccgaccgaaaggacgattaaactccgatggcattgggagccggcatcggcatccaattaaatatttataggtggtggatgggc

SEQ ID NO: 1189 - DNA, 225 bp, Unknown
  Encodes 16S rRNA from Anaerofustis
agagtttgatcatggctcaggacgaacgctggcggcgtgcttaacacatgcaagtcgaacgggaagctttggttagttcgctaaacaaagtggacagtggcgaacgggtgagtaacgcgtaggtaaccaacctcatactgggggatagcctttggaaacgaagagtaataccgcataagaccacactgtcgcatggcagaggggtaaaagatttatcggtatgag

SEQ ID NO: 1190 - DNA, 225 bp, Unknown
  Encodes 16S rRNA from Butyricicoccus
agagtttgatcctggctcaggataaacgctggcggcgcacataagacatgcaagtcgaacgggaactttattgaagttatctgatataaagttctagtggcggactggtgagtaatgtataagcaacctgcctgcaagaggggaataacagtgagaaatcattgctaataccgcataagctgtgagtatggcatcatacaaacagaaaaggaagcaattccgctt

SEQ ID NO: 1191 - DNA, 225 bp, Unknown
  Encodes 16S rRNA from Butyricicoccus
agagtttgatcctggctcaggatgaacgctggcggcgtgcataacacattcaagtcgaacggagatattgggatcaatccttcgggaagcgtttcaatattttagtggcggacgggtgagtaacgcgtgagcaacctgccttgaagagggggataacacagggaaacttgtgctaataccgcataacgtacgatggtcgcatggccgacgtaccaaagctccgac

SEQ ID NO: 1192 - DNA, 225 bp, Unknown
  Encodes 16S rRNA from Clostridium XlVa
agagtttgatcctggctcaggatgaacgctggcggcgtgcctaacacatgcaagtcgaacgaagacgcttattcagattctttcgggatgacgaatttgtggactgagtggcggacgggtgagtaacgcgtgggtaacctgccttgtacagggggacaacagttagaaatgactgctaataccgcataagccaacggaatcgcatgattcagttggaaaaactcc

SEQ ID NO: 1193 - DNA, 225 bp, Unknown
  Encodes 16S rRNA from Cryptanaerobacter
agagtttgatcatggctcaggacgaacgctggcggcatgcctaacacatgcaagtcgaacggaacaagactggctgtagcgatactttcggtcttgtttagtggcgaacgggtgagtaacacgtgagcaacctgccttttacacagggataacagccggaaacggctgctaataccggataagaccacaccgaggcatctcggaggggtcaaagcgatttagcgg

SEQ ID NO: 1194 - DNA, 225 bp, Unknown
  Encodes 16S rRNA from Clostridium XlVa
agagtttgatcatggctcaggatgaacgctggcggcgtgcttaatacatgcaagtcgaacgaagctgatgcgacggaacctttcggggggaagatgcattagactgagtggcggacgggtgagtaacgcgtgggtaacctgccttatacagggggataacatttggaaacagatgctaataccgcataagcgcacagaaccgcatggttcagtgtgaaaagctcc

SEQ ID NO: 1195 - DNA, 225 bp, Unknown
  Encodes 16S rRNA from Mogibacterium
agagtttgatcatggctcaggatgaacgctggcggcgtgcctaatacatgcaagtcgagcgagaatctcctttgaagcgttttcggacaattctgtggagaggaaagcggcggacgggtgagtaacgcgtaggcaacctgcccttagcagagggatagccattggaaacgatgattaaaacctcataatgccattcttacacatgttgggatggccaaagattta

SEQ ID NO: 1196 - DNA, 225 bp, Unknown
  Encodes 16S rRNA from Syntrophococcus
agagtttgatcatggctcaggatgaacgctggcggcgtgcttaacacatgcaagtcgaacggagctattttagaaagcggagcttgctctgatggatatgatagcttagtggcggacgggtgagtaacgcgtgggcaacctgccttacacagggggacaacagttggaaacgactgctaataccgcataagccggtaatctcgcatgggatatccggaaaagatt

SEQ ID NO: 1197 - DNA, 225 bp, Unknown
  Encodes 16S rRNA from Bacteroides
agagtttgatcatggctcaggatgaacgctagcggcaggcttaacacatgcaagtcgaggggcagcgtgggggtagcaatactcccgacggcgaccggcgcacgggtgagtaacgcgtatgcaacctttcccagacagggggatagcccagggaaacttggattaataccccgtaggccggatgagggcatcctcgtccggttaaagttccggcggtctggggtg

SEQ ID NO: 1198 - DNA, 225 bp, Unknown
  Encodes 16S rRNA from Treponema
agagtttgatcatggctcagaacgaacgctggcggcgcgtcttaagcatgcaagtcgggcgggattcatgtgcttgcacatgatgagagcggcggactggcgaggagcgcgtgggtgacgcaccccccggacggggacagccggcagaaatgccgggtgataccggatgaggtcccccttgttggaggagggggaggaaaggggcttcggccccgccgggggagc

SEQ ID NO: 1199 - DNA, 225 bp, Unknown
  Encodes 16S rRNA from Coraliomargarita
agagtttgatcatggctcagagtgaacgctggcggcgtggctaagacatgcaagttgagcgagaatataccttcgggtatagggaagcggcaaacgggtgagtaacacgtaagtaacctacccttgagactgggatagctcagcgaaagttgaggtaataccggatgacaaccattaacgcatgttaatggattcaaagggatgagacgatgctcaaggaggggc

SEQ ID NO: 1200 - DNA, 225 bp, Unknown
  Encodes 16S rRNA from Ruminococcus
agagtttgatcctggctcaggacgaacgctggcggcacgcttaacacatgcaagtcgaacgggactaagagagaagcttgcttcacttttagtttagtggcggacgggtgagtaacacgtgagtaacctgcccttatcaggggaatagcctccggaaacggagagtaataccgcataagatgacgatgtggcatcacatagtcataaaagattttatcggataag

SEQ ID NO: 1201 - DNA, 225 bp, Unknown
  Encodes 16S rRNA from Prevotella
agagtttgatcctggctcaggatgaacgctagctacaggcttaacacatgcaagtcgaggggcagcatgtcgtgtgcttgcacacgatgatggcgaccggcgcacgggtgagtaacgcgtatccaacctgcccatgactccgggatagcccgctgaaaagcggattaacaccggatggggtcgaacgaggacatctgatttcgaccaaagctttttgcggtcatg

SEQ ID NO: 1202 - DNA, 225 bp, Unknown
  Encodes 16S rRNA from Pseudaminobacter
agagtttgatcctggctcagaacgaacgctggcggcaggcttaacacatgcaagtcgagcgccccgcaaggggagcggcagacgggtgagtaacgcgtgggaatctacccaactctacggaataacccagggaaacttggactaataccgtatacgtcctccgggagaaagatttatcggagttggatgagcccgcgtcggattagctagttggtgaggtaatgg

SEQ ID NO: 1203 - DNA, 225 bp, Unknown
  Encodes 16S rRNA from Prevotella
agagtttgatcatggctcaggatgaacgctagcggcaggcttaacacatgcaagtcgaggggcagcgcgttgtagcaatacaatggcggcgaccggcgaaagggtgagtaacgcgtgagcgacgtgcccgtcacagggggacaagggctggaaacggcttctgataccccataggaatgtatgcttcatggtgtatgtttgaaagatttatcggtgacggatcgg

SEQ ID NO: 1204 - DNA, 225 bp, Unknown
  Encodes 16S rRNA from Treponema
agagtttgatcctggctcagaacgaacgctggcggcgcgtcttaagcatgcaagtcgagcggcaagatggggttcgccccgtcccagagcggcggactggtgagtaacacgtgggtgacgcaccctcgggatcgggatagcctgcagaaatgcagggtaataccggatgatgtccgtgcagccggaatgcacggaggaaaggggcttcggccccgccggaggaac

SEQ ID NO: 1205 - DNA, 225 bp, Unknown
  Encodes 16S rRNA from Syntrophococcus
agagtttgatcatggctcaggatgaacgctggcggcgtgcttaacacatgcaagtcgaacgggaactctagactgaaggttcgctggaagtttagaaattctagtggcggacgggtgagtaacgcgtgggtaacctgcctataagacgtgaacaacagttagaaatgactgctaatacacgataagcacaccagtatcgcatgatacagtgtgaaaagaatttcg

SEQ ID NO: 1206 - DNA, 225 bp, Unknown
  Encodes 16S rRNA from Clostridium IV
agagtttgatcatggctcaggatgaacgctggcggcgtgcataacacattcaagtcgaacggagatatactgattaatccttcgggaagcgtcggtatattttagtggcggacgggtgagtaacgcgtgagcaacctgccttgaagagggggataacacagggaaacttgtgctaataccgcataacatacaagaatcgcatggttttagtatcaaagctccgac

SEQ ID NO: 1207 - DNA, 225 bp, Unknown
  Encodes 16S rRNA from Tenacibaculum
agagtttgatcctggctcaggatgaacgctagcggcaggcttaacacatgcaagtcgaggggtaacaggcggtagcaatactgtgctgacgaccggcgcacgggtgcgtaacgcgtatgcaacctgcccgcgacagggggataacggagggaaacttccactaatatcccatggtgccgaaggttcgcatgggctttcggctaaaggggcgacccggttgcggat

SEQ ID NO: 1208 - DNA, 205 bp, Unknown
  Encodes 16S rRNA from Parabacteroides
agagtttgatcctggctcaggatgaacgctagcgacaggcttatggtcaatggacgcgagtctgaaccagccaagtcgcgtgcgggacgaaggccctccgggtcgtaaaccgctttagccggggagtaacgtgggggacgtgtccctcagtgagagtacccggagaataagcatcggctaactccgtgccagcagccgcggtaat

SEQ ID NO: 1209 - DNA, 225 bp, Unknown
  Encodes 16S rRNA from Luteimonas
agagtttgatcctggctcagaacgaacgctggcggcaggcctaaaacatgcaagttgaacgggtgtagcaatacatcagtagcggacgggtgaggaacatatgggaacgtgccctttggtgggggataacttctggaaacgggaggtaataccgcataagccatgagtgggaaatatttatagccggaggagcggcccatattggattagctagttggttaggta

SEQ ID NO: 1210 - DNA, 225 bp, Unknown
  Encodes 16S rRNA from Eubacterium
agagtttgatcctggctcaggacgaacgctggcggcgtgcttaacacatgcaagtcgaacgaagcttgaatttagatttcttcggaatgataaatgatatgactgagtggcggacgggtgagtaacgcgtgagcaacctgcccttcggagggggatagcgtttggaaacgaacggtaataccgcataatgttaacggatggcatcgtctgttaaccaaaactccg

SEQ ID NO: 1211 - DNA, 225 bp, Unknown
  Encodes 16S rRNA from Roseburia
agagtttgatcatggctcaggatgaacgctggcggcgtgcctaacacatgcaagtcgaacggacccatgggagtgattagcttgctatgaactcccggaaggttagtggcggacgggtgagtaacgcgtgggtaacctgcctcatacagggggatagcagttggaaacgactggtaataccgcataagcgcacagtaccgcatggtacagtgtgaaaagctccga

SEQ ID NO: 1212 - DNA, 225 bp, Unknown
  Encodes 16S rRNA from Oscillibacter
agagtttgatcatggctcaggacgaacgctggcggcgtgcttaacacatgcaagtcgaacgaagctctcacgcttgagttttcggacaagagggtgagaagacttagtggcggactggtgagtaacgcgtgagcaacctgccctccggtgggggacaacagttggaaacgactgctaataccgcataatgtacaggggccgcatgacccttgtaccaaagcttaa

SEQ ID NO: 1213 - DNA, 225 bp, Unknown
  Encodes 16S rRNA from unknown taxa
agagtttgatcatggctcaggacgaacgctggcggcgtgcttcatacatgcaagtcgaacgagaatcagaagcttgcttctgaggaaagtggcggacgggtgagtaatatgtagagaatctgccctttagatggggacaacagttggaaacgactgctaatacccaatatgcgcgtagttgagatactattcgtgaaaactccggtgctaaaggatgagtctgca

SEQ ID NO: 1214 - DNA, 225 bp, Unknown
  Encodes 16S rRNA from Prevotella
agagtttgatcatggctcaggatgaacgctagctacaggcttaacacatgcaagtcgaggggcagcacggaggtagcttgctacttttggtggcgaccggcgaatgggtgagtaacgcgtatccaacctgccgcgtgcccggggatagcccctggaaacggggattaagacccgatggcgtggtgccgccgcatgacggcgccattaaaccggcacgcgatgggg

SEQ ID NO: 1215 - DNA, 225 bp, Unknown
  Encodes 16S rRNA from Clostridium IV
agagtttgatcatggctcaggacgaacgctggcggcgcgcctaacacatgcaagtcgaacggagagtgcgctttgaatccttcgggacgattagctcatttcttagtggcggacgggtgagtaacacgtgagcaacctgccttgcagagcgggataacgattggaaacgatcgctaataccgcataatatatgattgtcgcatggctttcatatcaaagatttat

SEQ ID NO: 1216 - DNA, 225 bp, Unknown
  Encodes 16S rRNA from Treponema
agagtttgatcatggctcagaacgaacgctggcggcgcgtcttaagcatgcaagtcgagcgggattatccagcttgctggatatgagagcggcggactggtgagtaacacgtaggcaacgtacccttcggacggggatagccggcagaaatgtcgggtaataccggatgtgaacatgagccgtaaaggttcatgtggaaaggagcttcggctccgccggaggagc

SEQ ID NO: 1217 - DNA, 225 bp, Unknown
  Encodes 16S rRNA from Clostridium IV
agagtttgatcatggctcaggatgaacgctggcggcgtgcttaacacattcaagtcgaacggtgaagggggcttcggttcccggatcagtggcggacgggtgagtaacgcgtgaataacctgcctgtgtgtgggggataacagttggaaacggctgctaataccgcataacgtacggacaccgcatgatgaccgtaccaaagatttattgcgcacagatggattc

SEQ ID NO: 1218 - DNA, 225 bp, Unknown
  Encodes 16S rRNA from Victivallis
agagtttgatcctggctcagaacgaacgctggcggcatggattaggcatgcaagtcgaacgggtgcagcaatgcaccagtggcgcaagggtgaggaacacgtgagtaatctaccctcaagattgggatagctcctggaaacgggaattaataccggatgaaacagtttatccgcatggatgaacttttaaagcagcaatgcgcttgaggaggagctcgcgtccca

SEQ ID NO: 1219 - DNA, 225 bp, Unknown
  Encodes 16S rRNA from Clostridium XlVa
agagtttgatcctggctcaggatgaacgctggcggcgtgcctaacacatgcaagtcgaacgaagaccccgaggcagagatttcggtcgaagccaagggaggactgagtggcggacgggtgagtaacgcgtggataacctgccccatacagggggatagcagttggaaacgactgataataccgcataagcgcacgagggggcatcctcaagtgtgaaaaacttta

SEQ ID NO: 1220 - DNA, 225 bp, Unknown
  Encodes 16S rRNA from Oscillibacter
agagtttgatcatggctcaggacaaacgctggcggcgtgcctaacacatgcaagtcgaacggagcttatcaccttcgggaggtaagcttagtggcggactggtgagtaacgcgtgagcaacctgcccttcagtgggggacaacagccggaaacggctgctaataccgcatgagattatgggaaggcatcttcttgtaattaaagatttattgctgaaggatgggc

SEQ ID NO: 1221 - DNA, 225 bp, Unknown
  Encodes 16S rRNA from Papillibacter
agagtttgatcatggctcaggataaacgctggcggcgtgcataacacattcaagtcgaacgaagcacttcggaacgagacttcggtcaagtgaagatttgacttagtggcggacgggtgagtaacgcgtgagcaatctgcctcggggtgcgggataacgtttggaaacgaacgctaataccgcatgacgcatgaggttcacatggaccatatgccaaaggtttac

SEQ ID NO: 1222 - DNA, 225 bp, Unknown
  Encodes 16S rRNA from Cellulosilyticum
agagtttgatcatggctcaggataaacgctggcggcgcacataagacatgcaagtcgaacgagtttaatacctagcttgctaggtaagcgactagtggcggactggtgagtaacacgtaaggaacctgcctattagagaggaatacctttgagaaatcagagctaatacctcatatgccttatttatcgcatgataaaagagggaaaggagcaatccactaatag

SEQ ID NO: 1223 - DNA, 225 bp, Unknown
  Encodes 16S rRNA from Treponema
agagtttgatcctggctcagaacgaacgctggcggcgcgtcttaagcatgcaagtcgggcgggattccccagcttgctggggatgagagcggcggactggtgagtaacgcgtgggcgacgcgccccgtggaccgggatagcctgtggaaacacagggtaataccgggcgagctcccccgcgccggaggcgggggaggaaaggagccgaggctccgccacgggagc

SEQ ID NO: 1224 - DNA, 225 bp, Unknown
  Encodes 16S rRNA from Ruminococcus
agagtttgatcatggctcaggacgaacgctggcggcgtgcctaacacatgcaagtcgaacggagctgaggagcttgcttctcagcttagtggcggacgggtgagtaacgcgtgagtaacctgcctccgagagtggaataacgttttgaaaagaacgctaataccgcataatattatgaagtcgcatggctttataatcaaagagtatatcgctcggagatggact

SEQ ID NO: 1225 - DNA, 225 bp, Unknown
  Encodes 16S rRNA from Coraliomargarita
agagtttgatcctggctcagagtgaacgctggcggcgtggctaagacatgcaagttgagcgagaatatgctttcgggcatagggaagcggcaaacgggtgagtaacacgtaagtaacctgcccttgagactgggatagctcagcgaaagttgaggtaataccggatgacaaccattgatgcatgttaatggattgaaagggatgaaaggatgctcaaggaggggc

SEQ ID NO: 1226 - DNA, 225 bp, Unknown
  Encodes 16S rRNA from Butyricicoccus
agagtttgatcatggctcaggacgaacgctggcggcgtgcctaacacatgcaagtcgaacggagttgaggagcttgctccttaacttagtggcgatcggtagccggactgagaggttgaacggccacattgggactgagacacggcccagactcctacgggaggcagcagtgggggatattgcgcaatgggggcaaccctgacgcagcaacgccgcgtgaaggat

SEQ ID NO: 1227 - DNA, 225 bp, Unknown
  Encodes 16S rRNA from Blautia
agagtttgatcatggctcaggatgaacgctggcggcgtgcctaacacatgcaagtcgaacggagcttatggtgaaagatacttcggtagatggaagcgtaagcttagtggcggacgggtgagtaacgcgtggagaacctgccctgtaccgggggataacagagggaagcttctgctaataccgcataagcgcacggcaccgcatggtgcagtgtgaaaaactccg

SEQ ID NO: 1228 - DNA, 225 bp, Unknown
  Encodes 16S rRNA from Lachnospiracea incertae sedis
agagtttgatcatggctcaggatgaacgctggcggcacgcttaacacatgcaagtcgagcggagaattgacttcggttgattcttagcggcggacgggtgaggaacgcgtgggtaatctgccctatacaggggaataacacagagaaatttgtgataaaaccgcataagcccacgggatcgcatggtcctgtgagaaaaactccggtggtataggatgagcccgc

SEQ ID NO: 1229 - DNA, 225 bp, Unknown
  Encodes 16S rRNA from Prevotella
agagtttgatcatggctcaggatgaacgctagcggcaggcttaacacatgcaagtcgaggggcagcgcggggtagcaatactctggcggcgaccggcagacgggtgcgtaacgcgtatgcaacctacccaccacaggggtatagcccggcgaaagccggaataatcccccatggttccaacccaccgcatgatgagttggataaacccgcgagggggtgatggat

SEQ ID NO: 1230 - DNA, 225 bp, Unknown
  Encodes 16S rRNA from Clostridium IV
agagtttgatcatggctcaggacgaacgctggcggcatgcctaacacatgcaagtcgaacggagttatttggattcgtctggataacttagtggcggacgggtgagtaacacgtgagcaacctgcccttcagagggggacaacagctggaaacggctgctaataccgcataacatatacgaaaggcatcttttgtatatcaaagatttatcgctgagggatgggc

SEQ ID NO: 1231 - DNA, 225 bp, Unknown
  Encodes 16S rRNA from Clostridium IV
agagtttgatcatggctcaggatgaacgctggcggcgtgcataacacattcaagtcgaacgagcgagtgcccttcgggacacgagctagtggcggacgggtgagtaacgcgtgagcaacctgcccctgtgtgcgggataacgtcgggaaactgacgctaataccgcataacacatgagtcccgcatggggcatatgtcaaagatttattgcacagggatgggctc

SEQ ID NO: 1232 - DNA, 225 bp, Unknown
  Encodes 16S rRNA from Clostridium III
agagtttgatcatggctcaggacgaacgctggcggcgtgcctaacacatgcaagtcgaacgagaaatatggaaaggatcccttcggggagaatagaaatatggacagtggcggacgggcgagtaacgcgtgagtaacctgcccataagcgggggatagccgatggaaacgtcgagtaataccccatgatgtatatatatcgcatggtatatatattaaagattta

SEQ ID NO: 1233 - DNA, 225 bp, Unknown
  Encodes 16S rRNA from Neptunomonas
agagtttgatcctggctcaggatgaacgctagctacaggcttaacacatgcaagtcgaggggaatattgcacaatgggggaaaccctgatgcagccatgccgcgtgtgtgaagaaggccttcgggttgtaaagcacttttgcattcgaggaagacagcgtataaataaatgcgctatttgacgttagagtgtgaataagcaccggcaaactccgtgccagcagcc

SEQ ID NO: 1234 - DNA, 225 bp, Unknown
  Encodes 16S rRNA from Clostridium IV
agagtttgatcctggctcaggatgaacgctggcggcgtgcataacacattcaagtcgaacggacaccttcgggtgtcagtggcggacgggtgagtaacgcgtgagtaacctgccgcggattggggaataacgaccggaaacagtcgctaataccgcataacgcacgatgaccgcatggtcgacgtgccaaagatttatcgatccgcgatggactcgcgtccaatt

SEQ ID NO: 1235 - DNA, 225 bp, Unknown
  Encodes 16S rRNA from Howardella
agagtttgatcctggctcaggacgaacgctggcggcatgcttaacacatgcaagtcgaacggactgattccttcgggatgaaagttagtggcgaacgggtgagtaatgtatgagcaacctgcctctgtcaacgggataacagttggaaacgactgctaatacggtataagaccacggcaccgcatggtgctgcggtaaaagatttttcggacagagatgggctca

SEQ ID NO: 1236 - DNA, 225 bp, Unknown
  Encodes 16S rRNA from Clostridium IV
agagtttgatcatggctcaggatgaacgctggcggcgtgcataacacattcaagtcgaacggagatagaagcttcggtttttatcttagtggcggacgggtgagtaacgcgtgagcaacctgcccctgtgtgcgggataacgtttggaaacggacgctaataccgcatgacccaacgggaccgcatgatcttgttggcaaagattcattgcacagggatgggctc

SEQ ID NO: 1237 - DNA, 220 bp, Unknown
  Encodes 16S rRNA from Roseburia
agagtttgatcatggctcaggatgaacgctagctacaggcttaacacatgcaagtcgagaggcagcagtggggaatattgcacaatgggggaaaccctgatgcagcgacgccgcgtgagcgaagaagtatttcggtatgtaaagctctatcagcagggaagataatgacggtacctgactaagaagcaccggctaaatacgtgccagcagccgcggtaat

SEQ ID NO: 1238 - DNA, 225 bp, Unknown
  Encodes 16S rRNA from Oscillibacter
agagtttgatcctggctcaggacgaacgctggcggcgtgcttaacacatgcaagtcgaacgaagctctcacgcttgagttttcggacaagagggtgagatgacttagtggcggactggtgagtaacgcgtgagcaacctgccctccggtgggggacaacagttggaaacgactgctaataccgcataatgtacagagaccgcatgatctttgtaccaaagcttta

SEQ ID NO: 1239 - DNA, 225 bp, Unknown
  Encodes 16S rRNA from Clostridium XlVa
agagtttgatcatggctcaggatgaacgctggcggcgtgcttaacacatgcaagtcgaacgaggaattaccgatgaagttttcggatggatttggtttttccgagtggcggacgggtgagtaacgcgtgggtaacctgccttacactgggggacaacagagagaaatttctgctaataccgcataacccgctaggggcgcatgccccggacggaaaagatttatc

SEQ ID NO: 1240 - DNA, 225 bp, Unknown
  Encodes 16S rRNA from Clostridium IV
agagtttgatcatggcttaggatgaacgctggcggcgtgcataacacattcaagtcgaacggagagtgagcttcggctcacaatcagtggcggacgggtgagtaacgcgtgagcaacctgcccggaagcgtgggataacagagggaaacttctgctaataccgtatatcgtattcggatcgcatgttctgaatacaaaagggtttccgcttccggatgggctcgc

SEQ ID NO: 1241 - DNA, 225 bp, Unknown
  Encodes 16S rRNA from Sporobacter
agagtttgatcatggctcaggatgaacgctggcggcgtgcctaacacattcaagtcgaacggtgaagggacttcggtcccggatcagtggcggacgggtgagtaacgcgtgagcaacctgcctctgactgggggataacagccggaaacggctgctaataccgcataacgtgcgaccttcgcatgaaggacgcaccaaagatttatcggtcagagatgggctcgc

SEQ ID NO: 1242 - DNA, 225 bp, Unknown
  Encodes 16S rRNA from Clostridium XlVa
agagtttgatcctggctcaggatgaacgctggcggcgtgcctaacacatgcaagtcgaacgaagcatattggaaagagcccttcgggacgatggaagatatgacttagtggcggacgggtgagtaacgcgtgggcaacctgccgtacacagggggacaacagctggaaacggctgctaataccgcataagcgcacagcttcgcatggagtagtgtgaaaagcatt

SEQ ID NO: 1243 - DNA, 225 bp, Unknown
  Encodes 16S rRNA from Butyricicoccus
agagtttgatcctggctcaggatgaacgctggcggcgtgcataacacattcaagtcgaacgaagcacttcggacagatcccttcggggtgaagactgatttgacttagtggcggacgggtgagtaacgcgtgagcaacctgccttgaagagggggataacacagggaaacttgtgctaataccgcataacgtaccgacatcgcatggtgatggtaccaaagcctt

SEQ ID NO: 1244 - DNA, 225 bp, Unknown
  Encodes 16S rRNA from Clostridium XlVa
agagtttgatcatggctcagattgaacgctggcggcgtgcctaacacatgcaagtcgaacgagcgaggtatgaaacctagtgaataccgagcgagtggcggacgggtgagtaacgcgtgggtaacctgccttacagagggggataacagtctgaaaagactgctaataccgcataagcacacagtaccgcatggtacagggtgaaaagaattatcactgtaagat

SEQ ID NO: 1245 - DNA, 225 bp, Unknown
  Encodes 16S rRNA from Filomicrobium
agagtttgatcatggctcagaacgaacgctggcggcaggcctaacacatgcaagtcgaacgccctagcaatagggagtggcagacgggtgagtaacgcgtgggaaccttcccagtggtacggaatagcccagggaaacttggagtaataccgtataatacccgaaaggggaaagatttatcgccattggatgggcccgcgttggattagctagttggtgaggtaa

SEQ ID NO: 1246 - DNA, 225 bp, Unknown
  Encodes 16S rRNA from Bacteroides
agagtttgatcctggctcaggatgaacgctagctacaggcctaacacatgcaagtcgcggggcagcatgggcgtagcaatacgcctgatggcgaccggcgcacgggtgcgtaacgcgtatccaacctggcccttactcgggtatagccctgcgaaagtaggattaatccccgatgttgtcaagcgatagccttttcacttgaccaaagagttattcggtaaggga

SEQ ID NO: 1247 - DNA, 225 bp, Unknown
  Encodes 16S rRNA from Clostridium XlVa
agagtttgatcatggctcaggatgaacgctggcggcgtgcctaacacatgcaagtcgaacgggactttatggaatgcgattcgtcaaatgaaataaagtttagtggcggacgggtgagtaacgcgtgggtaacctgccttacagagggggataacggttggaaacgactgctaataccgcataagcccacagtaccgcatggtacagggggaaaagatttatcgc

SEQ ID NO: 1248 - DNA, 225 bp, Unknown
  Encodes 16S rRNA from Brevundimonas
agagtttgatcatggctcaggacgaacgctggcggtgtgcctcatacatgcaagtcgaacgataaggttccttcgggaatacataagtggcggacgggtgagtacaacataggaaatctgccccaaagcgggggacaacagagggaaacttctgctaataccccatacgagcttagttgaaatactaatcttgaaagatttatcactttgggatgagcctgtgcc

SEQ ID NO: 1249 - DNA, 225 bp, Unknown
  Encodes 16S rRNA from Clostridium IV
agagtttgatcatggctcaggacgaacgctggcggcgtgcctaacacatgcaagtcgagcggagacataagaggaagcggaagttttcggatggaagcggacatttatgttttagcggcggacgggtgagtaacgcgtgagcaacctgtccctcacagggggataacacaccgaaaggtgtactaataccgcatgacactgctgaaggacatcctatagcagtca

SEQ ID NO: 1250 - DNA, 225 bp, Unknown
  Encodes 16S rRNA from Paracoccus
agagtttgatcatggctcagaacgaacgctggcggcaggcctaacacatgcaagtcgagcgagaccttcgggtctagcggcggacgggtgagtaacgcgtgggaatatgcccttctctacggaatagtcctgggaaactgggggtaataccgtatacgccctttgggggaaagatttatcggagaaggattagcccgcgttggattaggtagttggtggggtaat

SEQ ID NO: 1251 - DNA, 225 bp, Unknown
  Encodes 16S rRNA from Schlegelella
agagtttgatcctggctcagattgaacgctggcggcatgccttacacatgcaagtcgaacggcagcgggggagcttgctcctgccggcgagtggcgaacgggtgagtaatgcatcggaacgtgtcctgttgtgggggataactgatcgaaagatcagctaataccgcatgagacctgagggtgaaagcgggggatcgaaagacctcgcgcgacaggagcggccga

SEQ ID NO: 1252 - DNA, 225 bp, Unknown
  Encodes 16S rRNA from Clostridium XI
agagtttgatcctggctcaggatgaacgctggcggcgtgcctaacacatgcaagtcgagcgaacccttcggggtgagcggcggacgggtgagtaacgcgtgggtaacctgccctgtacacacggataacataccgaaaggtatgctaatacgagataatatattttaatcgcatggttaagatatcaaagctccggcggtacaggatggacccgcgtctgattag

SEQ ID NO: 1253 - DNA, 225 bp, Unknown
  Encodes 16S rRNA from Diaphorobacter
agagtttgatcctggctcagattgaacgctggcggcatgccttacacatgcaagtcgaacggtaacggaccttcgggtgccgacgagtggcgaacgggtgagtaatacatcggaacgtgcccgatcgtgggggataacgaggcgaaagctttgctaataccgcatacgatctacggatgaaagcaggggaccgcaaggccttgcgcggacggagcggccgatggc

SEQ ID NO: 1254 - DNA, 225 bp, Unknown
  Encodes 16S rRNA from Clostridium sensu stricto
agagtttgatcatggctcaggacgaacgctggcggcgcgcctaacacatgcaagtcgaacgggactagtgaccggagcttagaagtcttctaggttgcgttcactagttcagtggcggacgggtgagtaaagcatgagtaactttcccattagtggggaatagcttttggaaacagaagataataccgcatacatcgttgaggactcatgttctcttcggaaaag

SEQ ID NO: 1255 - DNA, 225 bp, Unknown
  Encodes 16S rRNA from Saccharopolyspora
agagtttgatcctggctcaggacgaacgctggcggcgtgcttaacacatgcaagtcgaacgctgaagctctgcccttgtggtggggtggatgagtggcgaacgggtgagtaacacgtgggtaatctgccccatactctgggataacccctggaaacgggggctaataccggataggacattctgccgcatggtggggtgtggaaagttccggcggtatgggatgg

SEQ ID NO: 1256 - DNA, 225 bp, Unknown
  Encodes 16S rRNA from Prevotella
agagtttgatcctggctcaggatgaacgctagctacaggcttaacacatgcaagtcgaggggcatcaggtatcaagcttgcttgatatgctggcgaccggcgcacgggtgcgtaacacgtatcgaaccttcccgcctctccgggacagccctctgaaaggaggattaataccggatggcttcaccttgccgcatggcatggtgaataaagattcatcggagacgg

SEQ ID NO: 1257 - DNA, 225 bp, Unknown
  Encodes 16S rRNA from Eggerthella
agagtttgatcctggctcaggatgaacgctggcggcgtgcctaacacatgcaagtcgaacgatgaaaccgcctccgggcggacatgaagtggcgaacgggtgagtaacacgtgaccaacctgccccgcgcaccgggacagccccccgaaagggggattaataccggatactccggccgggccgcatggcccggccgggaaagctccggcggcgcgggatggggtc

SEQ ID NO: 1258 - DNA, 225 bp, Unknown
  Encodes 16S rRNA from Gelidibacter
agagtttgatcctggctcaggataaacgctagcggcaggcctaacacatgcaagtcgagcggcagcgggagtagcaatacttgccggcgagcggcggacgggtgagtaacgcgtatgcaacctgcccaccacacggagatagccgaccgaaaggacgattaaactccgatggcattgggacccggcatcgggatccaattaaatatttataggtggtggatgggc

SEQ ID NO: 1259 - DNA, 225 bp, Unknown
  Encodes 16S rRNA from Prevotella
agagtttgatcctggctcaggatgaacgctagctacaggcttaacacatgcaagtcgaggggcagcatggcggtggcttgccaccgccgatggcgaccggcgcacgggtgagtaacgcgtatccaacctgcccacaacctccgaatagcccgccgaaaggcggattaatgcgggatgtggtctgaagaagacatctgaactagaccaaaggttttttccggttgt

SEQ ID NO: 1260 - DNA, 225 bp, Unknown
  Encodes 16S rRNA from Pseudomonas
agagtttgatcatggctcagattgaacgctggcggcaggcctaacacatgcaagtcgagcggatgaagggagcttgctcccggattcagcggcggacgggtgagtaatgcctaggaatctgcctggtagtgggggacaacgttccgaaaggagcgctaataccgcatacgtcctacgggagaaagtgggggatcttcggacctcacgctatcagatgagcctagg

SEQ ID NO: 1261 - DNA, 225 bp, Unknown
  Encodes 16S rRNA from Prevotella
agagtttgatcatggctcaggatgaacgctagctacaggcttaacacatgcaagtcggggggcagcacggggtgcagcaatgcacttgggtggcgaccggcgaatgggtgagtaacgagtatccaacctgccccgcgctccgggacagccccgcgaaagcgggattaataccggatgcggcatggttcccgcatgggctccatgtcaaagattcatcggcgcggg

SEQ ID NO: 1262 - DNA, 225 bp, Unknown
  Encodes 16S rRNA from Prevotella
agagtttgatcatggctcaggatgaacgctagctacaggcttaacacatgcaagtcgaggggcatcggggaggtagcttgctatctctgccggcgaccggcgcacgggtgagtaacgcgtatccaacctgccgcatagtcgggcacagccctctgaaaggaggattaatgccggatgtggtcttagtgagacatctcatatagactgaagatttattgctatgcg

SEQ ID NO: 1263 - DNA, 225 bp, Unknown
  Encodes 16S rRNA from Prevotella
agagtttgatcatggctcaggatgaacgctagctacaggcttaacacatgcaagtcgaggggcagcatggcggtggcttgccactgccgatggcgaccggcgcacgggtgagtaacgcgtatccaacctgcccgcaaccgcggaatagcccgccgaaaggcggattaatgccgcatgagctcgcgtgggggcatctgcccgcgagcaaaggttcactccggttgc

SEQ ID NO: 1264 - DNA, 225 bp, Unknown
  Encodes 16S rRNA from Brevundimonas
agagtttgatcatggctcaggacgaacgctggcggtgtgcctcatacatgcaagtcgaacgagaagctttcttcggaaagtggaaagtggcggacgggtgagtacaacataggaaatctgccctaaagtgggggacaacagagggaaactcctgctaataccccatacgagcttagttgaaatactaatcttgaaagatttatcgctttaggatgagcctgtgcc

SEQ ID NO: 1265 - DNA, 225 bp, Unknown
  Encodes 16S rRNA from Bacteroides
agagtttgatcctggctcaggatgaacgctggcggcgtgcctaacacatgcaagtcgaggggcagcatggtcttagcttgctaaggccgatggcgaccggcgcacgggtgagtaacgcgtatccaacctgccgtccagtaggggacagcccgtagaaatgcggattaataccctatgttctccgaggatgacatcagattcggagtaaagattcatcgctggacg

SEQ ID NO: 1266 - DNA, 225 bp, Unknown
  Encodes 16S rRNA from Clostridium XlVa
agagtttgatcctggctcaggataaacgctggcggcgtgcttaacacatgcaggtcgaacgaggtatcgaagattaatcttcggaagcgtttttgataccgagtggcggacgggtgagtaacgcgtgggtaacctgcccggaagagggggacaacagttggaaacgactgctaataccgcataagccgacggagccgcatggctctgccggaaaaggagtgatcc

SEQ ID NO: 1267 - DNA, 209 bp, Unknown
  Encodes 16S rRNA from Photobacterium
agagtttgatcctggctcagattgaacgctggcgggggaatattgcacaatgggggaaaccctgatgcagccatgccgcgtgtgtgaagaaggccttcgggttgtaaagcacttttgcattcgaggaagacagcgtataaataaatgcgctatttgacgttagagtgtgaataagcaccggcaaactccgtgccagcagccgcggtaat

SEQ ID NO: 1268 - DNA, 225 bp, Unknown
  Encodes 16S rRNA from Clostridium XlVa
agagtttgatcatggctcaggatgaacgctggcggcgtgcttaatacatgcaagtcgaacgggataaattggaagcttgcttttgatttatctagtggcggacgggtgagtaacgcgtgggtaacctgcctcatacagggggataacagttagaaatgactgctaaaaccgcataacattgtggtaccgcatgatatcacgatcaaatatttataggtatgagat

SEQ ID NO: 1269 - DNA, 225 bp, Unknown
  Encodes 16S rRNA from Clostridium XlVb
agagtttgatcatggctcaggatgaacgctggcggcgtgcctaacacatgcaagtcgagcgaagggttgagagcttgctcttaactacttagcggcggacgggtgagtaacgcgtgggtaacctgccctgtacagaggaataacagttagaaatgactgctaatgcctcataagccgacgaaatggcatcattatgtcggaaaagatttatcggtacaggaggga

SEQ ID NO: 1270 - DNA, 225 bp, Unknown
  Encodes 16S rRNA from Prevotella
agagtttgatcatggctcaggatgaacgctagctacaggcttaacacatgcaagtcgaggggcagcagggcaatagcttgctattgctgctggcgaccggcgcacgggtgagtaacgcgtatccaacctaccccgcggtcagggacagcccggcgaaagtcggattaatacctgatgcagtcagaagagggcatctgattttgacgaaagattttatcgcctcgg

SEQ ID NO: 1271 - DNA, 225 bp, Unknown
  Encodes 16S rRNA from Clostridium IV
agagtttgatcatggctcaggacgaacgctggcggcgtgcttaacacatgcaagtcgaacgaagcttgatttatgatttcttcggaatgaataatgatatgacttagtggcggacgggtgagtaacgcgtgaggaacctgcctttcagagggggacaacatttggaaacgaatgctaataccgcataacgcattttaaggacatccttttaatgccaaagattta

SEQ ID NO: 1272 - DNA, 225 bp, Unknown
  Encodes 16S rRNA from Anaeroplasma
agagtttgatcatggctcaggattaacgctggcggcgtgcctaatacatgcaagtcggatggttagcttgctaaccatggcgaacgggtgagtaacacgtaggtaacctgtctaagacacgaggataaccattggaaacgatggataatactggataggacatttgaaggcatctttggatgtttaaagatttatcggtaatagaggggcctgcggcgcattagc

SEQ ID NO: 1273 - DNA, 225 bp, Unknown
  Encodes 16S rRNA from Caldilinea
agagtttgatcctggctcaggatgaacgctggcggcgtgcttaacacatgcaagtcgaacgtgagggtgcagcaatgtacctgaaagtggcaaacgggtgagtaacacgtagatgacctgcctcgtagtgggggataaccacgggaaactgtggctaataccgcatggtcttgttagtatgggaatactttcaagtaaagctttatgtgctatgagaggggtctg

SEQ ID NO: 1274 - DNA, 225 bp, Unknown
  Encodes 16S rRNA from Clostridium XlVa
agagtttgatcatggctcaggatgaacgctggcggcgtgcctaacacatgcaagtcgaacggagacttggcgctgacgagtgaaatagcttgctatggaacaaatcttgccaagacttagtggcggacgggtgagtaacgcgtggacaacctggcccatacagggggacagcagctggaaacggctgataataccgcataagcgcacagtatcacatggtacagt

SEQ ID NO: 1275 - DNA, 225 bp, Unknown
  Encodes 16S rRNA from Victivallis
agagtttgatcatggctcagaatgaacgctggcggcatggattaggcatgcaagtcgaacggggcgcagcgatgcgcccagtggcgaaagggtgagtagcacgtgaagaacctgcccccggatccggaacaagcgctggaaacggcgtctgatacgggatgtggacgtcccccgcatggggggcgctctaaagattcatcgtccggggagggcttcgcgtcccat

SEQ ID NO: 1276 - DNA, 225 bp, Unknown
  Encodes 16S rRNA from Brevundimonas
agagtttgatcatggctcaggacgaacgctggcggcgtgcttcatacatgcaagtcgaacgagaatctctagcttgctagagaggaaagtggcggacgggtgagtaatatgtagagaatctgccctagagagtgggacaacagagggaaacttctgctaataccgcatatgcgcgtagctgagatgctattcgtgaaaactctggtgctctgggatgagtctgca

SEQ ID NO: 1277 - DNA, 225 bp, Unknown
  Encodes 16S rRNA from unknown taxa
agagtttgatcatggctcaggatgaacgctggcggcgtgcttcatacatgcaagtcgaacgagaaatgatagcttgctatcatggaaagtggcggacgggtgagtaatacatagggaatctgcccttagccgggggacaacagttggaaacgactgctaataccgcatatgagtatagttttatacttgaaaactccggtggctaaggatgagcctgtgcctgat

SEQ ID NO: 1278 - DNA, 225 bp, Unknown
  Encodes 16S rRNA from Prevotella
agagtttgatcatggctcaggatgaacgctagctacaggcttaacacatgcaagtcgaggggcagcatgtcagtggcttgccactgatgatggcgaccggcgcacgggtgagtaacgcgtatccaaccttcccccaagtagggaatagcccggcgaaagtcggattaatgccctatgttttccttatgtgagcattctgtgaggaacaaagattgatcgcttggg

SEQ ID NO: 1279 - DNA, 225 bp, Unknown
  Encodes 16S rRNA from Slackia
agagtttgatcctggctcaggatgaacgctggcggcgtgcctaacacatgcaagtcgaacggagaagccgccctcgggcgggtatgaagtggcgaacgggtgagtaacacgtgaccaacctgccccgcgcaccgggacaaccccccgaaaggggggctgataccggatacgcccccggcgccgcatggcggcggggggaaagcccagacggcgcgggatggggtc

SEQ ID NO: 1280 - DNA, 225 bp, Unknown
  Encodes 16S rRNA from Pedobacter
agagtttgatcatggctcaggatgaacgctagcggcaggcttaacacatgcaagtcgaggggcatcgcgggagtagcaatacacctggcggcgaccggcggaagggtgcgtaacgcgtgagcaacatgcccgtcacagggggataacagatggaaacgtctcctaataccccgtaacatcatctgcggcatcgcaggtggttgaaagtttcggcggtgacggatt

SEQ ID NO: 1281 - DNA, 225 bp, Unknown
  Encodes 16S rRNA from Prevotella
agagtttgatcctggctcaggatgaacgctagctacaggcttaacacatgcaagtcgaggggcagcacggttgttgcttgcaacaactggtggcgaccggcgcacgggtgagtaacgcgtatccaacctgcccgcaaccgcggaatagcccgccgaaaggcggattaatgccgcatgagctcgcgcgagggcatcatttcgcgagcaaaggttcactccggttgc

SEQ ID NO: 1282 - DNA, 225 bp, Unknown
  Encodes 16S rRNA from Trueperella
agagtttgatcatggctcaggacgaacgctggcggcgtgcttaacacatgcaagtcgaacgatgaagctggtgcttgcactggtggattagtggcgaacgggtgagtaatacgtgagtaacctgcccttgtctttgggataagcctgggaaactgggtctaatactggatattctgcgctggccgcatggttggtgttggaaagggttatggactggatggggat

SEQ ID NO: 1283 - DNA, 225 bp, Unknown
  Encodes 16S rRNA from Oscillibacter
agagtttgatcatggctcaggataaacgctggcggcgcacataagacatgcaagtcgaacggaagtcgtaattaaaaaggaacaaagatttatcggagtgagattttaactacaatggctttagtggcggactggtgagtaatgtataagtaacctgcctattagaggggaacaacagttggaaacagctgctaataccgcatatgccataagaaccgcatggtt

SEQ ID NO: 1284 - DNA, 225 bp, Unknown
  Encodes 16S rRNA from unknown taxa
agagtttgatcatggctcaggatgaacgctggcggcgtgcttcatacatgcaagtcgaacgagaattggtagcttgctaccaaggaaagtggcggacgggtgagtaatacatagggaatctgcccttagctgggggacaacagttggaaacgactgctaataccgcatatgagtatagttgagatattatacttgaaaactccggtggctagggatgagcctgtg

SEQ ID NO: 1285 - DNA, 225 bp, Unknown
  Encodes 16S rRNA from Victivallis
agagtttgatcatggctcagaatgaacgctggcggcatggattaggcatgcaagtcgaacggggtccttcgggacctagtggcgaaagggtgagtaacacgtgagcaatctgcccccaaggccggaataagcactggaaacggtgtctaaaaccggatgaggcctggagtcgcatgactcctcagccaaatattcataccctggggatgagctcgcggcccatta

SEQ ID NO: 1286 - DNA, 225 bp, Unknown
  Encodes 16S rRNA from Bacteroides
agagtttgatcatggctcaggatgaacgctagcggcaggcttaacacatgcaagtcgaggggcagcggagaagtagcaatacttctgccggcgaccggcgcacgggtgagtaacgcgtatgcaacctttcccagacagggggatagcccagggaaacttggattaataccccgtaggccgtggggcggcatcgccctatggttaaagttccggcggtctggggtg

SEQ ID NO: 1287 - DNA, 225 bp, Unknown
  Encodes 16S rRNA from Micrococcus
agagtttgatcatggctcaggatgaacgctggcggcgtgcttaacacatgcaagtcgaacgatgaagcccagcttgctgggtggattagtggcgaacgggtgagtaacacgtgagtaacctgcccttaactctgggataagcctgggaaactgggtctaataccggataggagcgcctaccgcatggtgggtgttggaaagatttatcggttttggatggactcg

SEQ ID NO: 1288 - DNA, 225 bp, Unknown
  Encodes 16S rRNA from Olivibacter
agagtttgatcatggctcaggatgaacgctagcggcaggcctaatacatgcaagtcgtacggtaagcggtccttcgggaccgtgagagtggcggacgggtgcgtaacgcgtatgcaaccaacccccctcgccgggatagccggtggaaacgccggataataccggatgcgccgcgggggaggcatcttcccggcggcaaggcggagacgcggagggggacgggca

SEQ ID NO: 1289 - DNA, 225 bp, Unknown
  Encodes 16S rRNA from Anaerophaga
agagtttgatcatggctcaggatgaacgctagcgacaggcctaacacatgcaagtcgaggggtaacagggagcttgctccgctgacgaccggcgcacgggtgagtaacgcgtatgcaacctgcccgcgggatcgggatagccccccgaaagggggattaacaccggatgaggctgcgagggggcatccccatgtagccaaatgcgaagctcgcggatgggcatgc

SEQ ID NO: 1290 - DNA, 225 bp, Unknown
  Encodes 16S rRNA from Selenomonas
agagtttgatcatggctcaggacgaacgctggcggcgtgcttaacacatgcaagtcgaacggggcgattgaaagcttgcttttatgagcctagtggcaaacgggtgagtaacgcgtgggcaacctgccggaaagatggggacaacatcccgaaaggggtgctaataccgaatgttgtatacggggcgcatgccttgtatattaaaggattttatccgctttccga

SEQ ID NO: 1291 - DNA, 151 bp, Unknown
  Encodes 16S rRNA from Megasphaera
agagtttgatcctggctcagattgaacgctggcggcaggcttaacacatgcaagtcgtacggtaacagagggaagcttgcttctctgctgacgagtgacggtaccgaacatagaaagccacggctaactacgtgccagcagccgcggtaat

SEQ ID NO: 1292 - DNA, 225 bp, Unknown
  Encodes 16S rRNA from Clostridium XlVa
agagtttgatcctggctcaggatgaacgctggcggcgtgcctaacacatgcaagtcgaacgaagcacacggattgatcccttcggggtgattgaagtatgactgagtggcggacgggtgagtaacgcgtgggtaacctgcctcatacagggggataacagttagaaatgactgctaataccgcataagcgcacagcatcgcatggtgcagtgtgaaaaactccgg

SEQ ID NO: 1293 - DNA, 225 bp, Unknown
  Encodes 16S rRNA from Clostridium XlVa
agagtttgatcatggctcaggatgaacgctggcggcgtgcctaacacatgcaagtcgaacggggtacagacgctgtgagaagaagtgcttgcacggaatcaaacttgtttgtacttagtggcggacgggtgagtaacgcgtggaaaacctgcctcatacagggggataacaggaagaaattcctgctaataccgcataagcgcacaggaaggcatctttcagtgt

SEQ ID NO: 1294 - DNA, 225 bp, Unknown
  Encodes 16S rRNA from Eubacterium
agagtttgatcatggctcaggatgaacgctggcggcgtgcttaacacatgcaagtcgagcgagaaatcgctcagttgatacttcggttgaaaacagagcgacggaaagcggcggacgggtgagtaacgcgtgggaaacctgccctttacagggggacagccgagggaaacttcgattaataccccataatgccatagtatcgcatggtaccatggccaaagattt

SEQ ID NO: 1295 - DNA, 225 bp, Unknown
  Encodes 16S rRNA from unknown taxa
agagtttgatcatggctcaggatgaacgctggcggcgtgcttcatacatgcaagtcgaacgagaattgatagcttgctatcaaggaaagtggcggacgggtgagtaatacatagggaatctgcccttagctgggggacaacagttggaaacgactgctaataccgcatatgagtatgattgagatattatacttgaaaactccggtggctaaggatgagcctgtg

SEQ ID NO: 1296 - DNA, 225 bp, Unknown
  Encodes 16S rRNA from Clostridium XlVa
agagtttgatcatggctcaggatgaacgctggcggcgtgcctaacacatgcaagtcgaacggaaatgttttgatgaagatttcggttggattcaatacattttagtggcggacgggtgagtaacacgtgggtaacctgccctgtaccgggggataacacttagaaataggtgataataccgcataagcgcacactgaggcatctcagagtgtgaaaaactccggt

SEQ ID NO: 1297 - DNA, 225 bp, Unknown
  Encodes 16S rRNA from Treponema
agagtttgatcctggctcagaacgaacgctggcggcgcgtcttaagcatgcaagtcgagcgggattacctagcttgctaggtatgagagcggcggactggtgagtaacgcgtgggtgacgtacccttctgacggggatagccggtagaaataccgggtaataccggatgcgttctcctgtcttggaagcaggagaagaaaggagctacggctccgcaggaggaac

SEQ ID NO: 1298 - DNA, 225 bp, Unknown
  Encodes 16S rRNA from Cryptanaerobacter
agagtttgatcatggctcaggacgaacgctggcggcatgcctaacacatgcaagtcgaacggaataagaatggctgtagcgatactttcgttcttatttagtggcgaacgggtgagtaacacgtgagcaacctgccttctacacagggataacagccggaaacggctgctaataccggataagaccacactgaggcatctcagaggggtcaaagcgatttagcgg

SEQ ID NO: 1299 - DNA, 225 bp, Unknown
  Encodes 16S rRNA from Xanthomonas
agagtttgatcctggctcagagtgaacgctggcggcaggcctaacacatgcaagtcgaacggcagcacaggagagcttgctctctgggtggcgagtggcggacgggtgaggaatacatcggaatctaccttgtcgtgggggataacgtagggaaacttacgctaataccgcatacgacctacgggtgaaagcaggggaccttcgggccttgcgcgattggatgag

SEQ ID NO: 1300 - DNA, 225 bp, Unknown
  Encodes 16S rRNA from Asteroleplasma
agagtttgatcatggctcaggataaacgccggcggcgtgcctaatacatgcaagtcgaacgggagtagcaatactctagtggcgtacgggtgagtaacacgttggtaacctaccccaaggaccggaataccaaggagaaatctttgctaatgccggatgaaaccatagaagcgcaagcttcattgatcaaaggcggcaattgccgcgccatgggatggacctgcg

SEQ ID NO: 1301 - DNA, 225 bp, Unknown
  Encodes 16S rRNA from unknown taxa
agagtttgatcatggctcaggatgaacgctggcggcgtgcttcatacatgcaagtcgaacgagaattggtagcttgctaccaaggaaagtggcggacgggtgagtaatacatagggaatctgcccttagccgggggacaacagttggaaacgactgctaataccgcatatgaggtaagttgagatacttatcttgaaaactccggtggctaaggatgagcctgtg

SEQ ID NO: 1302 - DNA, 225 bp, Unknown
  Encodes 16S rRNA from Sporotomaculum
agagtttgatcctggctcaggacgaacgctggcggcgtgcttaacacatgcaagtcgaacgaggaatgttgaaaagcttgctttttgacatttcgagtggcggacgggtgagtaacgcgtgaggaacctgtcttctacagggggataacgtcccgaaagggacgctaataccgcataagaccacagtatcgcatgatacaggggtcaaaggagcaatccggtaga

SEQ ID NO: 1303 - DNA, 225 bp, Unknown
  Encodes 16S rRNA from Bacteroides
agagtttgatcatggctcaggatgaacgctagcgacaggcctaacacatgcaagtcgaggggcagcatggttggtagcaataccgactgatggcgaccggcgcacgggtgcgtaacaggtgtgcaatctgtcctataccaagggatagcccgctgaaaggcggattaaaactttatgtgtcatatggaggcatctctgtgtgatgaaacgcgagggtataggatg

SEQ ID NO: 1304 - DNA, 225 bp, Unknown
  Encodes 16S rRNA from Asaccharobacter
agagtttgatcatggctcaggatgaacgctggcggcgtgcttaacacatgcaagtcgaacgattaacccgccttcgggcggtcatagagtggcgaacgggtgagtaacacgtgaccaacctgccccgcgcaccgggacagcctcgcgaaagcgggattaataccggatactccgggggcgccgcatggcgcccccgggaaagctccggcggcgcgggatggggtc

SEQ ID NO: 1305 - DNA, 225 bp, Unknown
  Encodes 16S rRNA from Clostridium IV
agagtttgatcatggctcaggacgaacgctggcggtatgcctaacacatgcaagtcgaacgagtgtcgaagagcttgctcttcttctactagtggcggacgggtgagtaacgcgtgagtaatctgcctcaaagtgggggataacacttagaaatgagtgctaataccgcgtaatgtgctagcttcgcatgaagtctgcaccatagtttttcgctttgagatgagc

SEQ ID NO: 1306 - DNA, 225 bp, Unknown
  Encodes 16S rRNA from unknown taxa
agagtttgatcatggctcaggacgaacgctggcggcgtgcttcatacatgcaagtcgaacgagaaactgacttcggttagtggaaagtggcggacgggtgagtaatgtgtagagaatctgccctggagagtgggacaacagttggaaacgactgctaataccgcatatgagcgtacctgcaatggtattcttgaaatgaattatcgctccgggatgagtctgcat

SEQ ID NO: 1307 - DNA, 225 bp, Unknown
  Encodes 16S rRNA from Clostridium XlVa
agagtttgatcctggctcaggatgaacgctggcggcgtgcttaatacatgcaagtcgaacgagcagagatattcgtatcgaagcgagtggcggacgggtgagtaacgcgtgggaaacctgccctataccgggggataacagttggaaacgactgctaataccgcataagcgcacggagttgcatgactctgtgtgaaaaactccggtggtataggatggtcccgc

SEQ ID NO: 1308 - DNA, 225 bp, Unknown
  Encodes 16S rRNA from Treponema
agagtttgatcatggctcagaacgaacgctggcggcgcgtcttaagcatgcaagtcgaacggcaagctagacttcggtttagcctagagtggcggactggtgagtaacgcgtagatgacgtaccttaaggatggggatagccgatagaaatatcgggtaataccgaatacggtcactgctgttagagggcagtgaggaaagcagctatggctgcgccttaagaac

SEQ ID NO: 1309 - DNA, 225 bp, Unknown
  Encodes 16S rRNA from Prevotella
agagtttgatcctggctcaggatgaacgctagctacaggcttaacacatgcaagtcgaggggcagcgggggcgtagcaatacgcctgccggcgaccggcgcacgggtgagtaacgcgtatccaacctcccccccagtaggggatagcccggcgaaagtcggattaataccctatgtcgtccaggacgggcatcttttccggacgaaagattgatcgctgggggat

SEQ ID NO: 1310 - DNA, 225 bp, Unknown
  Encodes 16S rRNA from Turicibacter
agagtttgatcatggctcaggatgaacgctggcggtatgcttaatacatgcaagtcgagcgagatcttcggatcgagcggcgaacgggtgagtaacacgtaggtaatctgccctttagactgggataccctgaggaaacttaggctaataccggatatgaacttcgaaggcatctttgaagtttgaaagttccgtttggaacactttgggatgaacctgcggcgc

SEQ ID NO: 1311 - DNA, 225 bp, Unknown
  Encodes 16S rRNA from Clostridium IV
agagtttgatcatggctcaggacgaacgctggcggcgtgcctaacacatgcaagtcgaacggagttattagagtgaagttttcggatggagcgaagataacttagtggcggacgggtgagtaacgcgtgagtaacctgcccattagagggggataacgttctgaaaagaacgctaataccgcataacatattcggttcgcatgaactgaatatcaaaggagtaat

SEQ ID NO: 1312 - DNA, 225 bp, Unknown
  Encodes 16S rRNA from Clostridium IV
agagtttgatcatggctcaggatgaacgctggcggcgtgcataacacattcaagtcgaacggactgattttgtagcttgctacgaatgaaagttagtggcggacgggtgagtaacgcgtgagcaacctgcctctgtgtgtgggataccgtctggaaacggacgttaataccgcatgatccatagagatcgcatgatatttatggcaaagatttattgcacagaga

SEQ ID NO: 1313 - DNA, 225 bp, Unknown
  Encodes 16S rRNA from Clostridium IV
agagtttgatcatggctcaggacaaacgctggcggcgtgcttaacacatgcaagtcgaacggagtacccgagaaagaagcttcggcagattgatcggaatacttagtggcggacgggtgagtaacacgtgagtaacctgcccttgagtgggggataacactccgaaaggagtgctaataccgcataacatggatatgttgcatggcaaatccatcaaagatttat

SEQ ID NO: 1314 - DNA, 225 bp, Unknown
  Encodes 16S rRNA from Oscillibacter
agagtttgatcctggctcaggacgaacgctggcggcgtgcttaacacatgcaagtcgaacgaagctctcacactcgagttttcggacaagagagtgagatgacttagtggcggactggtgagtaacgcgtgagcaacctgccctccggtgggggacaacagctggaaacggctgctaataccgcataatgtgtacggaccgcatgatctgtacaccaaagcttta

SEQ ID NO: 1315 - DNA, 225 bp, Unknown
  Encodes 16S rRNA from Deinococcus
agagtttgatcatggctcagggtgaacgctggcggcgtgcttaagacatgcaagtagaacggtcttttcggagacagtggcgcacgggtgagtaacacgtaactgacctgccccaaagtcgcggataactgggtgaaagtccagctaatacgtgatgtgctgtcagattttgttctgccagtaaaggtttactgctttgggatggggttgcgttccatcagctag

SEQ ID NO: 1316 - DNA, 225 bp, Unknown
  Encodes 16S rRNA from Pedobacter
agagtttgatcatggctcaggatgaacgctagcggcaggcctaatacatgcaagtcgaacggtaaatgtcccttcggggacatgagagtggcggacgggtgcgtaacgcgtatgcaaccaacccccctcaccgggatagccggtggaaacgccggataacaccggatgcgcccatggggaggcatctccctgcgggcaaggcggcgacgcggagggggacgggca

SEQ ID NO: 1317 - DNA, 225 bp, Unknown
  Encodes 16S rRNA from Anaerovorax
agagtttgatcctggctcaggatgaacgctggcggcgtgcctaacacatgcaagtcgagcgggaatgtccggaatgaaacttcggtcgaatgaagggcaggacagcggcggacgggtgagtaacgcgtaggtaagctgccccttgcacagggatagcctcgggaaactgggattaatacctgataaagcgcagacagcacatgctgactgcgccaaagatttatc

SEQ ID NO: 1318 - DNA, 225 bp, Unknown
  Encodes 16S rRNA from Clostridium IV
agagtttgatcatggctcaggacgaacgctggcggcgtgcctaacacatgcaagtcgaacggacttagctgagtgcttgcactcggcgacagttagtggcggacgggtgagtaacgcgtgaataacctgcccaacagagggggataacgtttggaaacgaacgctaataccgcataacattggagcatcgcatggtgttctaatcaaaggagcaatccgctgatg

SEQ ID NO: 1319 - DNA, 225 bp, Unknown
  Encodes 16S rRNA from Bacteroides
agagtttgatcctggctcaggatgaacgctagctacaggcctaacacatgcaagtcgaggggcagcgcgggtagcaatacctggcggcgaccggcgcacgggtgcgtaacaggtgtgcaatctgtcctataccgggggatagcccggcgaaagccgaattaaaactccatgtgtcacgaagccgcatgactttgtgatgaaacgttatagggtatagggtgagca

SEQ ID NO: 1320 - DNA, 225 bp, Unknown
  Encodes 16S rRNA from Clostridium IV
agagtttgatcatggctcaggatgaacgctggcggcgtgcataacacattcaagtcgaacgaagcactgtcgaggaagtcttcggatggaattgactttgacttagtggcggacgggtgagtaacgcgtgagcaaccttcctgtttgtgagggataacacagggaaacttgtgctaataccgcatgatgcatgggaatcgcatggtttcgatgccaaagatttat

SEQ ID NO: 1321 - DNA, 225 bp, Unknown
  Encodes 16S rRNA from Rhodococcus
agagtttgatcatggctcaggacgaacgctggcggcgtgcttaacacatgcaagtcgaacggtaaggccccttcgggggtacacgagtggcgaacgggtgagtaacacgtgggtgatctgccctgcactctgggataagcctgggaaactgggtctaataccggatatgagctcctgtcgcatggcgggggttggaaaggtttactggtgcaggatgggcccgcg

SEQ ID NO: 1322 - DNA, 225 bp, Unknown
  Encodes 16S rRNA from Treponema
agagtttgatcatggctcagaacgaacgctggcggcgcgtcttaagcatgcaagtcggacggcaagatcggtgcttgcactgatcctagagtggcggactggtgagtaacgcgtgggtgacgtaccctccggacggggatagctactagaaatagtagataataccggatacggtgcactgtgtcagaggcagtgcaggaaaggttcttttgaaccgccggagga

SEQ ID NO: 1323 - DNA, 225 bp, Unknown
  Encodes 16S rRNA from Mucilaginibacter
agagtttgatcatggctcaggatgaacgctagcggcaggcctaatacatgcaagtcggacgggatctccccttcgggggagtgagagtggcgcacgggtgcgtaacgcgtatgcaaccaaccctcatccgggggacagccggtggaaacgccgggtaataccccataccgattcctgtgggcatccacggggattgaaagacttaggtcggaggaggacgggcat

SEQ ID NO: 1324 - DNA, 225 bp, Unknown
  Encodes 16S rRNA from Clostridium XlVa
agagtttgatcatggctcaggatgaacgctggcggcgtgcctaacacatgcaagtcgaacggtgatgagcagaaattttcggatggaagcttatcatagtggcggacgggtgagtaacgcgtggataacctgcctcttgctgggggatagcagccggaaacggctggtaataccgcatacgttcatttccccgcatggggaggtgaggaaagatttatcggcgag

SEQ ID NO: 1325 - DNA, 225 bp, Unknown
  Encodes 16S rRNA from Olivibacter
agagtttgatcctggctcaggatgaacgctagcggcaggcctaatacatgcaagtcggacgggatctccccttcgggggagtgagagtggcgcacgggtgcgtaacgcgtatgcaaccaaccctcatccgggggacagccggtggaaacgccgggtaataccccatatccactttgggaggcatcttctgaggtggaaagacttaggtcggaggaggacgggcat

SEQ ID NO: 1326 - DNA, 225 bp, Unknown
  Encodes 16S rRNA from Clostridium XlVa
agagtttgatcatggctcaggatgaacgctggcggcacgcttaacacatgcaagtcgaacgaggttatgaacttcggttaataacctagtggcggacgggtgcgtaacgcgtgggtaatctgcccttgacagggggataacgtatagaaatgtacgctaataccgcataagcccacggagaggcatctctctgagggaaaagggatactggtcaaggatgagccc

SEQ ID NO: 1327 - DNA, 225 bp, Unknown
  Encodes 16S rRNA from Barnesiella
agagtttgatcatggctcaggatgaacgctagcgacaggcctaacacatgcaagtcgaggggcagcatggagtagcaatactctgatggcgaccggcgcacgggtgcgtaacaggtgtgcaatctgtcctataccgggggatagcccggcgaaagccgaattaaaactccatgtgagcgattggcgcatgccagtctcttgaaacgtttagggtatagggtgagc

SEQ ID NO: 1328 - DNA, 225 bp, Unknown
  Encodes 16S rRNA from Clostridium XlVb
agagtttgatcatggctcaggatgaacgctggcggcgtgcctaacacatgcaagtcgagcgaagaattgagagcttgctcttaattacttagcggcggacgggtgagtaacgcgtgggtaacctgccctgtacaggggaataacagttagaaatgactgctaatgccccataagccgacgaaatggcatctttatgtcggaaaagatttatcggtacaggaggga

SEQ ID NO: 1329 - DNA, 225 bp, Unknown
  Encodes 16S rRNA from Gelidibacter
agagtttgatcctggctcaggataaacgctagcggcaggcctaacacatgcaagtcgagcggcagcgggagtggcaacacttgccggcgagcggcggacgggtgagtaacgcgtatgcaacctgcccatcacacggagatagccgaccgaaaggacgattaaactccgatggcatcaagagggggcatccccatttgattaaatattcataggtgatggatgggc

SEQ ID NO: 1330 - DNA, 225 bp, Unknown
  Encodes 16S rRNA from Methanobrevibacter
agagtttgatcatggctcaggacgaacgctggcggcgtgcctaacacatgcaagtcgaacgaatttagattcgtggcgtacggctcagtaacacgtggataacctacccttaggactgggataactctgggaaactggggctaataccggatagatgatttttcttggaatgggattttgtttaaatgttttttcgcctaaggatgggtctgcggcagattaggt

SEQ ID NO: 1331 - DNA, 225 bp, Unknown
  Encodes 16S rRNA from Anaerotruncus
agagtttgatcatggctcaggacgaacgctggcggcgtgcctaacacatgcaagtcgaacggagtttactttttagatttcttcggaatgacgagttgtaaacttagtggcggacgggtgagtaacgcgtgagcaacctgcctttcagagggggacaacagttggaaacgactgctaataccgcataatattaggtttagacatctttacctaatcaaaggagca

SEQ ID NO: 1332 - DNA, 225 bp, Unknown
  Encodes 16S rRNA from Lachnospiracea incertae sedis
agagtttgatcatggctcaggatgaacgctagctacaggcttaacacatgcaagtcgaacgaggcgaggagtgcttgcacaccgaacctagtggcggacgggtgcgtaacgcgtgggtaacctgccctaaacagggggataacgtatagaaatgtacgctaataccgcataagctcacggaaccgcatggttttgagggaaaaggatttccggtttaggatgggc

SEQ ID NO: 1333 - DNA, 225 bp, Unknown
  Encodes 16S rRNA from Erysipelotrichaceae incertae sedis
agagtttgatcatggctcaggatgaacgctggcggcatgcctaagacatgcaagtcgtacgaggtggcccattgaaatggagtgcttgcacaaagtggatttggattcccacctagtggcggaagggtgagtaacacgtaggtaatctaccttagagactgggataacaattagaaatgattgctaataccggatgataattatgaggtaaacttgtaatttaaa

SEQ ID NO: 1334 - DNA, 225 bp, Unknown
  Encodes 16S rRNA from Mesorhizobium
agagtttgatcatggctcagaacgaacgctggcggcaggcttaacacatgcaagtcgaacgccccgcaaggggagtggcagacgggtgagtaacgcgtgggaatctacccatcactacggaacaactccgggaaactggagctaataccgtatacgtccttcgggagaaagatttatcggtgatggatgagcccgcgttggattagctagttggtggggtaatgg

SEQ ID NO: 1335 - DNA, 225 bp, Unknown
  Encodes 16S rRNA from Clostridium XI
agagtttgatcatggctcaggacgaacgctggcggcgtgcctaacacatgcaagtcgagcggggatttagtggaaggaagcttcggcggacggaaggtaaatcttagcggcggacgggtgagtaacgcgtgaacaatctgtcccggacagggggataacacatggaaacaggtgctaataccgcataagaccacagcgtcgcatggcggtggggtaaaaggagga

SEQ ID NO: 1336 - DNA, 225 bp, Unknown
  Encodes 16S rRNA from Planctomyces
agagtttgatcatggctcagaatgaacgttggtagcgtggattaggcatgcaagtcgagcgacaaggtttcttcggaaactggaggagcggcaaacggggtaggataacatcggaacgtaccctcttgtccgggatacccgcgggaaactgcggttaataccggataatcccgaaagggcaaaggtccgccgcgggaggagcggccgatgtgatatcagctagtt

SEQ ID NO: 1337 - DNA, 225 bp, Unknown
  Encodes 16S rRNA from Aerococcus
agagtttgatcctggctcaggacgaacgctggcggcatgcctaatacatgcaagtcgagcgaacagatgaagtgcttgcacttctgacgttagcggcgaacgggtgagtaacacgtaaggaatctacctataagcgggggataacattcggaaacgggtgctaataccgcataatatcttcttccgcatggaagaagattgaaagacggctctgctgtcacttat

SEQ ID NO: 1338 - DNA, 225 bp, Unknown
  Encodes 16S rRNA from Victivallis
agagtttgatcatggctcagaacgaacgctggcggcatggattaggcatgcaagtcgaacggtgcagcaatgcatagtggcgcaagggtgaggaacgcgtgagtaatctgccctcaagttgggaacagcttctggaaacggaaattaataccgaatgtgaccattggaaggcatctttcagtggttaaaggccgcaaggtcgcttgaggaggggctcgcgtccca

SEQ ID NO: 1339 - DNA, 225 bp, Unknown
  Encodes 16S rRNA from unknown taxa
agagtttgatcctggctcaggacgaacgctggcggcgtgcttcatacatgcaagtcgaacgagaatcaggagcttgcttctgaggaaagtggcggacgggtgagtaatatgtagagaatctgcccttaagcgggggacaacagttggaaacgactgctaataccccatatgcgcgtagttgcgatactattcgtgaaaactccggtgcttaaggatgagtctgca

SEQ ID NO: 1340 - DNA, 225 bp, Unknown
  Encodes 16S rRNA from Bacteroides
agagtttgatcctggctcaggatgaacgctagctacaggcttaacacatgcaagtcgcggggtatcgcggtgagtagcaatactttctggcggcgaccggcggatgggtgagtaacgcgtatccaacctggccctatctcggggacagcccctcgaaagagggattaatacccgatgttccctggtttccgcatgtttaccagggcaaaggcttttgtcggatag

SEQ ID NO: 1341 - DNA, 225 bp, Unknown
  Encodes 16S rRNA from Clostridium XI
agagtttgatcatggctcaggatgaacgctggcggcgtgcctaacacatgcaagtcgagcgagaagttgctgacggagatttcggtcaacagaagcgatggatagcggcggacgggtgagtaacgcgtaggtaagctgccccgcacacaggaatagcctagggaaacctggattaatgcctgatgacgcggcggagtcacatggctctgtcgccaaagatttatc

SEQ ID NO: 1342 - DNA, 225 bp, Unknown
  Encodes 16S rRNA from Clostridium XlVa
agagtttgatcctggctcaggatgaacgctggcggcgtgcctaacacatgcaagtcgaacgaagaccccgaagcggagatttcggttgaagcagagggaggactgagtggcggacgggtgagtaacgcgtggataacctgccccatacagggggatagcagttggaaacgactgataataccgcatgagcgcacgtggagacatctccatgtgtgaaaagattta

SEQ ID NO: 1343 - DNA, 200 bp, Unknown
  Encodes 16S rRNA from Ruminococcus
agagtttgatcatggctcagattgaacgctggcggcaggcttaacacatgcaagtcgtacggtaacggagggaactctgatgcagcgatgccgcgtggaggaagaaggttttcggattgtaaactcctgtttcgagggacgataatgacggtacctcgggaggaagctccggctaactacgtgccagcagccgcggtaat

SEQ ID NO: 1344 - DNA, 225 bp, Unknown
  Encodes 16S rRNA from Saccharofermentans
agagtttgatcatggctcaggatgaacgctggcggcgtgcctaacacattcaagtcgaacggagaagaaggcttcggccttcggatcagtggcggacgggtgagtaacgcgtgagtaatctgcctttgattggggaataacacagggaaacctgtgctaataccgcataacacagcgacaccgcatgatgatgctgtcaaagaattatcgatcaaagatgagctc

SEQ ID NO: 1345 - DNA, 225 bp, Unknown
  Encodes 16S rRNA from Oscillibacter
agagtttgatcctggctcaggacgaacgctggcggcgtgcctaacacatgcaagtcgaacgaagctcttttcaatgcgattcgtcaagttgaaaggatgacttagtggcgaacgggtgagtaacgcgtgagcaacctgccccggagtgggggacaacagttggaaacgactgctaataccgcatgatatatactaacggcatcgttggtatatcaaagatttatt

SEQ ID NO: 1346 - DNA, 225 bp, Unknown
  Encodes 16S rRNA from Lachnospiracea incertae sedis
agagtttgatcatggctcaggatgaacgctggcggcgtgcttaacacatgcaagtcgaacgaagcaccctcacctcgatactgaatgcgagcttgctcaaatgacgtatcacccgagggtgactgagtggcggacgggtgagtaacgcgtgggtaacctgccttagacagggggataacaacaagaaattgttgctaataccgcataagcacacagcatcgcatg

SEQ ID NO: 1347 - DNA, 207 bp, Unknown
  Encodes 16S rRNA from Fibrobacter
agagtttgatcctggctcaggatgaacgctagctacaggcttaacacatgcaaatgggggaaaccctgatgcagcaacgccacgtgtgggaagaagcatttcggtgtgtaaaccactgtcgtgagggaataatacgcgtcttcgggcgcgggagaatgtacctcgaaaggaagcaccggcaaacttcgtgccagcagccgcggtaat

SEQ ID NO: 1348 - DNA, 225 bp, Unknown
  Encodes 16S rRNA from Kiloniella
agagtttgatcctggctcagaacgaacgctggcggcaggcttaacacatgcaagtcaagggggtgtagcaatacacaaccggcgcacgggtgagtaacgcgtgggaatatgtccatttgtggggaatagcttctggaaacggaaggtaataccgcatacgcccttcgggggaaagatttatcgcagatggagtggcccgcgttagattagctagttggtgaggta

SEQ ID NO: 1349 - DNA, 225 bp, Unknown
  Encodes 16S rRNA from Olivibacter
agagtttgatcatggctcaggatgaacgctagcggcaggcttaacacatgcaagtcgaggggcagcgcgttgtagcaatacaatggcggcgaccggcggaagggtgcgtaacgcgtgagcaacctgcccctgtcagggggatagtcgatggaaacgtcgcgtaataccccgtacgatgcggagtcgcatgattctgcattaaaagatttatcggacagggatggg

SEQ ID NO: 1350 - DNA, 225 bp, Unknown
  Encodes 16S rRNA from Clostridium IV
agagtttgatcatggctcaggatgaacgctggcggcgtgcataacacattcaagtcgaacgaagcaccggcgaggaagtcttcggatggaattgcccttgacttagtggcggacgggtgagtaacgcgtgagcaaccttcctgcttgtgagggataacacagggaaacttgtgctaataccgcatgacgcacgattgtcgcatggcagatgtgccaaagatttat

SEQ ID NO: 1351 - DNA, 225 bp, Unknown
  Encodes 16S rRNA from Spirochaeta
agagtttgatcctggctcagaacgaacgctggcggcgcgttttaagcatgcaagtcgagcggtaagccggagcaatccggcctagagcggcggacgggtgagtaacacgtggataatctggcctacagtttgggatagcctggtgaaagtcaggataataccggatacgacggtttggtcacaagagcgaatcgggaaaggggctaaggcctcgctgaaggatga

SEQ ID NO: 1352 - DNA, 225 bp, Unknown
  Encodes 16S rRNA from Prevotella
agagtttgatcatggctcaggatgaacgctagctacaggcttaacacatgcaagtcgaggggcagcatgtcgtgtgcttgcacgcgatgatggcgaccggcgcacgggtgagtaacgcgtatccaacctgcccatgaccccgggatagcccgctgaaaagcggattaacaccggatgcggtcgaaagaggacatctgatttcgaccaaagcttcggcggtcatgg

SEQ ID NO: 1353 - DNA, 225 bp, Unknown
  Encodes 16S rRNA from Olivibacter
agagtttgatcctggctcaggatgaacgctagcggcaggcctaatacatgcaagtcgaacggtaaacgccccttcgggggtgtgagagtggcgcacgggtgcgtaacgcgtatgcaacccacccgctgccgggggatagcccggagaaatccgaattaataccccatgaggagtaaccaaggcatcttggttatttcaaaacttcggtggcggcggacgggcatg

SEQ ID NO: 1354 - DNA, 225 bp, Unknown
  Encodes 16S rRNA from Prevotella
agagtttgatcatggctcaggatgaacgctagctacaggcttaacacatgcaagtcgaggggcatcaggtatcaagcttgcttgatatgctggcgaccggcgcacgggtgcgtaacacgtatcgaaccttcccgcctctccgggacagccctctgaaaggaggattaataccggatggcttcgcggagccgcatggctctgcgaataaagatttatcggagacgg

SEQ ID NO: 1355 - DNA, 225 bp, Unknown
  Encodes 16S rRNA from Parabacteroides
agagtttgatcatggctcaggatgaacgctagcgacaggcttaacacatgcaagtcgaggggcagcgggggcgatggcaacattgcccgccggcgaccggcgcactggtgagtaacacgtatgcaacctgccccgcacagggggataacccagagaaatttggcctaataccccgtaacaccgttgggggcatccccggtggttgaaagaggcgactcggtgcgg

SEQ ID NO: 1356 - DNA, 225 bp, Unknown
  Encodes 16S rRNA from Prevotella
agagtttgatcctggctcaggatgaacgctagctacaggcttaacacatgcaagtcgcggggcagcatggaggttgcttgcaacctctgatggcgaccggcgcacgggtgagtaacgcgtatccaacctgccctgcggtagggaacagcccggcgaaagtcggattaatgccctatgtgctcatttgaaggcatctgattttgagcaaaggattcgttcgccgca

SEQ ID NO: 1357 - DNA, 225 bp, Unknown
  Encodes 16S rRNA from Leifsonia
agagtttgatcctggctcaggacgaacgctggcggcgtgcttaacacatgcaagtcgaacggtgaacgagggagcttgcttcctccggatcagtggcgaacgggtgagtaacacgtgagcaatctgccccgaactctgggataagcgttggaaacgacgtctaataccggatacgacgcgggagggcatcctctccgcgtggaaagaatttcggttcgggatgag

SEQ ID NO: 1358 - DNA, 225 bp, Unknown
  Encodes 16S rRNA from Clostridium IV
agagtttgatcctggctcaggacgaacgctggcggcgtgcttaacacatgcaagtcgaacgagaatccggggaaggagttttcggacaacggaaccggaggaaagtggcggacgggtgagtaacgcgtgaggaacctgccttggagagggggacaacagctggaaacggctgctaataccgcatgatacgtgatggggacatccctgacacgtcaaagatttatc

SEQ ID NO: 1359 - DNA, 225 bp, Unknown
  Encodes 16S rRNA from Victivallis
agagtttgatcctggctcagaacgaacgctggcggcatggattaggcatgcaagtcgaacggtgtagcaatgcacagtggcgcaagggtgaggaacgcgtgagtaatctaccctcaagttgggaacagcttctggaaacggaaattaataccgaatgtgaccgttggaaggcatcttctgatggttaaaggccgcaaggtcgcttgaggaggggctcgcgtccca

SEQ ID NO: 1360 - DNA, 225 bp, Unknown
  Encodes 16S rRNA from Treponema
agagtttgatcatggctcagaacgaacgctggcggcgcgtcttaagcatgcaagtcgaacggcaagttaccttcgggtaacctagagtggcggactggtgagtaacacgtaggtgacgtaccccccggacggggatagctcctagaaataggagataataccggataaggttgcacgggctggaaccgtgtaaggaaaggtgcttcggcaccgccgggggagcgg

SEQ ID NO: 1361 - DNA, 225 bp, Unknown
  Encodes 16S rRNA from unknown taxa
agagtttgatcatggctcaggacgaacgctggcggcgtgcttcatacatgcaagtcgaacgagaagttaccttcgggtaatggatagtggcggacgggtgagtaatgtgtagagaatctgccttcaagagggggatagcagttggaaacgactattaataccccatatgcgcgtagttggaatactattcgtgaaagattaatcgcttgaagatgagtctgcatc

SEQ ID NO: 1362 - DNA, 225 bp, Unknown
  Encodes 16S rRNA from Sporotomaculum
agagtttgatcctggctcaggacgaacgctggcggcgtgcttaacacatgcaagtcgaacgaggaatgccaaaaagcttgctttttaacatttcgagtggcggacgggtgagtaacgcgtgaggaacctgtcttctacagggggataacgtcccgaaagggacgctaataccgcataagaccacggtatcgcatgatacaggggtcaaaggagcaatccggtaga

SEQ ID NO: 1363 - DNA, 225 bp, Unknown
  Encodes 16S rRNA from Spirochaeta
agagtttgatcctggctcagaacgaacgctggcggcgcgttttaagcatgcaagttgagcggtaacttggatttattcaagctagagcggcggacgggtgagtaacacgtggataatctggcctacagttgggaatagcctgatgaaagtcaggataatgccgaatgagcagttgacggcacaagctgttgattggaaaggggctaaggcctcgctgaaggatga

SEQ ID NO: 1364 - DNA, 225 bp, Unknown
  Encodes 16S rRNA from Clostridium III
agagtttgatcctggctcaggacgaacgctggcggcgcgcctaacacatgcaagtcgaacgggactagtgaccggagagtagatgaggatctattttgcgatcactagttcagtggcggacgggtgagtaaagcatgagcaacctggctactagagggggatagcttttggaaacagaagataataccgcatacatcaaagatttcgcatgagatttttggaaaa

SEQ ID NO: 1365 - DNA, 225 bp, Unknown
  Encodes 16S rRNA from Clostridium XlVa
agagtttgatcatggctcaggatgaacgctggcggcgtgcctaacacatgcaagtcgaacgaggctctgcgaaatgaagattcgtctgattttcaaagatgtccgagtggcggatgggtgagtaacgcgtggagaacctgccctatgctgggggataacaactggaaacggttgacaataccgcataagcttccatggtcgcatgaccttggaaggaaagattta

SEQ ID NO: 1366 - DNA, 225 bp, Unknown
  Encodes 16S rRNA from Anaerovorax
agagtttgatcatggctcaggatgaacgctggcggcgtgcctaacacatgcaagtcgagcgagaattccctgaatgaaacttcggtcgaatgacgggaaggaaagcggcggacgggtgagtaacgcgtaggcaacctgccctttgcagagggatagccactggaaacggtgattaaaacctcataacacgggactgagacatctcagacccgccaaagatttatc

SEQ ID NO: 1367 - DNA, 225 bp, Unknown
  Encodes 16S rRNA from Oscillibacter
agagtttgatcatggctcaggacgaacgctggcggcgtgcttaacacatgcaagtcgaacgagtgagcgttattgcactaagttaactaatgaagttaatttagtgcaatagtgcaagctagtggcggactggtgagtaacgcgtgagcaacctacctttaacagggggataacacttagaaataggtgctaataccgcataacattaagttgtggcatcacaat

SEQ ID NO: 1368 - DNA, 225 bp, Unknown
  Encodes 16S rRNA from Victivallis
agagtttgatcatggctcagaacgaacgctggcggcatggattaggcatgcaagtcgaacgaagcagcaatgcttagtggcgaaagggtgaggaacgcgtgagtaatctgcccccaagttgggaataacagctggaaacggctgctaataccgaatgtggctgattgaccgcatggttgattggctaaagatttatcgcttggggatgagctcgcgtcccattag

SEQ ID NO: 1369 - DNA, 225 bp, Unknown
  Encodes 16S rRNA from Lachnospiracea incertae sedis
agagtttgatcctggctcaggatgaacgctggcggcgtgcttaacacatgcaagtcgaacggagtattagattttttaatacttagtggcggacgggtgagtaacgcgtgggtaacctgcctcacacagggggataacagttggaaacgactgttaataccgcataagaccacagtaccgcatggtacaggggtaaaaactccggtggtgtgagatggacccgcg

SEQ ID NO: 1370 - DNA, 225 bp, Unknown
  Encodes 16S rRNA from Spirochaeta
agagtttgatcatggctcagaacgaacgctggcggcgcgtcttaagcatgcaagtcgagcgggaaacagtagcttgctactgttgagagcggcggactggtgagtaacacgtgggtgacgcacccctgtgagggggacagccggcagaaatgccgggtaataccgcatacgattgccttaagtgatgttgaggcaatgaaaggagcgaatgctccgcgcagggag

SEQ ID NO: 1371 - DNA, 225 bp, Unknown
  Encodes 16S rRNA from Clostridium XlVb
agagtttgatcctggctcaggatgaacgctggcggcgtgcctaacacatgcaagtcgaacgagagaagcgaaaagcttgctttttgccgatcgagtggcggacgggtgagtaacgcgtgagcaacctgccttacattggggaataacgtttggaaacggacggtaataccgcatatgcagacaagtacggcatcgtacggtttggaaagatttatcgatgtaaga

SEQ ID NO: 1372 - DNA, 225 bp, Unknown
  Encodes 16S rRNA from Oscillibacter
agagtttgatcatggctcaggacgaacgctggcggcgtgcttaacacatgcaagtcgaacggggcgcagcgacggaagttttcggacggaagacgctgttgccaagtggcggacgggtgagtaacgcgtgaggaacctgcctttcagagggggacaacagttggaaacgactgctaataccgcataatgcggcgagacggcatcgtcttgccgccaaaggagcaa

SEQ ID NO: 1373 - DNA, 225 bp, Unknown
  Encodes 16S rRNA from Prevotella
agagtttgatcatggctcaggatgaacgctagctacaggcttaacacatgcaagtcgaggggcagcatggcggtggcttgccaccgccgatggcgaccggcgcacgggtgagtaacgcgtatccaacctgcccgcaaccgcggaatagcccgccgaaaggcggattaatgccgcatgagcccgcgagacggcatcagcgcgcgggcaaaggtatattccggttgt

SEQ ID NO: 1374 - DNA, 225 bp, Unknown
  Encodes 16S rRNA from Anaeroplasma
agagtttgatcctggctcaggattaacgctggcggcgtgcctaatacatgcaagtcgaatggtggtagcaatacaaaccatggcgaacgggtgagtaacacgtaggtaacctatcttaaagacgaggataaccattggaaacgatggataatactggataggacatcataaagggcatccttagatgtttaaaggagcaatccacttttagaggggcctgcggcg

SEQ ID NO: 1375 - DNA, 225 bp, Unknown
  Encodes 16S rRNA from Adlercreutzia
agagtttgatcatggctcaggatgaacgctggcggcgtgcttaacacatgcaagtcgaacggttaaaccggcttcggccggacatagagtggcgaacgggtgagtaacacgtgaccaacctgccccgcgcaccgggacagcctcgcgaaagcgggattaataccggatactccggcgggggcgcatgcccccgccgggaaagctccggcggcgcgggatggggtc

SEQ ID NO: 1376 - DNA, 225 bp, Unknown
  Encodes 16S rRNA from Clostridium XlVa
agagtttgatcatggctcaggatgaacgctggcggcgtgcttaacacatgcaagtcgaacgaagcattacgtttcaaagcctccgggcagcgagatgttttgacttagtggcggacgggtgagtaacgcgtgggtaacctgccttgtactgggggataacagttagaaatgactgctaataccgcataagcccacggtttcgcatggaactgtgagaaaagattt

SEQ ID NO: 1377 - DNA, 225 bp, Unknown
  Encodes 16S rRNA from Beijerinckia
agagtttgatcatggctcagaacgaacgctggcggcaggcttaacacatgcaagtcgaacgccccgcaaggggagtggcagacgggtgagtaacgcgtgggaatctaccgtgccctgcggaatagctccgggaaactggaattaataccgcatacgccctacgggggaaagatttatcggggtatgatgagcccgcgttggattagctagttggtggggtaaagg

SEQ ID NO: 1378 - DNA, 225 bp, Unknown
  Encodes 16S rRNA from Prevotella
agagtttgatcatggctcaggatgaacgctagctacaggcttaacacatgcaagtcgaggggcagcatgtcggtggcttgccaccggcgatggcgaccggcgcacgggtgagtaacgcgtatccaacctgcccgcaaccgcggaatagcccgccgaaaggcggattaatgccgcatgagctcgcgcgagggcatctgatcgcgagcaaaggttgattccggttgc

SEQ ID NO: 1379 - DNA, 225 bp, Unknown
  Encodes 16S rRNA from Coprococcus
agagtttgatcatggctcaggatgaacgctggcggcgtgcctaacacatgcaagtcgaacgaagcacttctcccgtcaaaggtgattagcttgctatgaagcggagacatttgaagtgacttagtggcggacgggtgagtaacgcgtgggtaacctgccccataccgggggacaacagttggaaacggctgctaataccgcataagcgcacgatgtcgcatggca

SEQ ID NO: 1380 - DNA, 225 bp, Unknown
  Encodes 16S rRNA from Lentisphaera
agagtttgatcatggctcagaatgaacgctggcggcatggattaggcatgcaagtcgaacgagaaagcggcctcggccgcgagtaaagtggcgaaagggtgagtagcacgtggggaacctgccccggggaccggaacaagcccgtgaaaacgggtctgaaaccggatgtcgccccggcccgcatgggccggaggcgaaaaattcattgccccgggatggccccgc

SEQ ID NO: 1381 - DNA, 225 bp, Unknown
  Encodes 16S rRNA from Clostridium XlVa
agagtttgatcctggctcaggatgaacgctggcggcgtgcttaacacatgcaagtcgaacggagatatatttatgaagttttcggatggaatatatatatcttagtggcggacgggtgagtaacgcgtaaacaatctgccttagagagggggataacagatagaaatatctgctaataccgcataagaccacgtacaggcatctagacggggtaaaaggagtaat

SEQ ID NO: 1382 - DNA, 225 bp, Unknown
  Encodes 16S rRNA from Saccharofermentans
agagtttgatcatggctcaggacgaacgctggcggcgtgcctaacacatgcaagtcgagcggactctttacaggaaagtgcttgcaccggaatgtaaagagttagcggcggacgggtgagtaacgcgtgagcaatctgtcccatacagggggataataccgcgaaagaggttctaataccgcatgagaccacagtgaggcatctcacaggggtcaaaggagcaat

SEQ ID NO: 1383 - DNA, 225 bp, Unknown
  Encodes 16S rRNA from Porphyrobacter
agagtttgatcatggctcagaacgaacgctggcggcatgcctaacacatgcaagtcgaacgagaccttcgggtctagtggcgcacgggtgcgtaacgcgtgggaacctgcccttaggttcggaataactccccgaaaggggtgctaataccggataatgtcttcggaccaaagatttatcgcctttggatgggcccgcgttggattagcttgttggtgaggtaac

SEQ ID NO: 1384 - DNA, 225 bp, Unknown
  Encodes 16S rRNA from Rhodobacter
agagtttgatcatggctcagaatgaacgctggcggcaggcctaacacatgcaagtcgaacgaagtcttcggacttagtggcggacgggtgagtaacacgtgggaacgtaccctttgctacggaatagcctcgggaaactgggagtaataccgtatgtgcccttcgggggaaagatttatcggcaaaggatcggcccgcgttggattagctagttggtggggtaat

SEQ ID NO: 1385 - DNA, 225 bp, Unknown
  Encodes 16S rRNA from Oscillibacter
agagtttgatcctggctcaggacgaacgctggcggcgtgcctaacacatgcaagtcgaacgagaatctaatgacggagttttcggacaactgagttagaggaaagtggcggactggtgagtaacgcgtgagcaacctgcctttcagagggggacaacagttggaaacgactgctaataccgcataacatacacatgaggcatctcgagtgtatcaaaggagcaat

SEQ ID NO: 1386 - DNA, 225 bp, Unknown
  Encodes 16S rRNA from Roseburia
agagtttgatcatggctcaggatgaacgctggcggcgtgcttaacacatgcaagtcgaacggggtattaacgctgaacgagcgaatagcttgctaggaacgagttcttgttaagacctagtggcggacgggtgagtaacgcgtgggtaacctgcccattaccgggggacaacagttggaaacgactgctaataccgcataagcgcacggggacgcatgtttctgt

SEQ ID NO: 1387 - DNA, 225 bp, Unknown
  Encodes 16S rRNA from Prevotella
agagtttgatcctggctcaggatgaacgctagctacaggcttaacacatgcaagtcgaggggcatcaggaggtcagcttgctgaccttgctggcgaccggcgcacgggtgagtaacacgtatccaacctgccctgtacacggggatagccctctgaaaggaggattaatacccgatgttgtcgcggagggacatccctctgcgaccaaagtctcaacggtacggg

SEQ ID NO: 1388 - DNA, 225 bp, Unknown
  Encodes 16S rRNA from Aquiflexum
agagtttgatcatggctcaggatgaacgctggcggcaggcttaatacatgcaagtcgaacggtaaggccgagcgtagcaatacgcgaggtacacgagtggcgcacgggtgcgtaacgcgtatgcaacctgcccccttccgggacaaaacgtcgagaaattggcgctaatatcccatggcgaccttatgaggcatctcgtttggtccaaagattcattggaagggg

SEQ ID NO: 1389 - DNA, 225 bp, Unknown
  Encodes 16S rRNA from Rhodopirellula
agagtttgatcatggctcagaatgaacgttggcggcgtggattaggcatgcaagtcgtacggtaagccccatagcttgctacggggcctagagtggcgaaagggataggataatgtagatgacataccctcgggaccgggatagcgtttggaaacgaacggtaataccggataacatctccggatcaaaggtgagattccgcctgaggattggtttacacactat

SEQ ID NO: 1390 - DNA, 225 bp, Unknown
  Encodes 16S rRNA from Bacteroides
agagtttgatcctggctcaggatgaacgctagctacaggcttaacacatgcaagtcgaggggcagcattaagtcagcttgctgatttagatggcgaccggcgcacgggtgagtaacgcgtatccaacctgccccctacccggggatagccttgcgaaagtaagattaatacccggtgctgttatgatcccgcatggggatataacgaaagattcatcggtagggg

SEQ ID NO: 1391 - DNA, 225 bp, Unknown
  Encodes 16S rRNA from Bacteroides
agagtttgatcctggctcaggatgaacgctagctacaggcttaacacatgcaagtcgaggggcagcatggccgaagcttgcttcggccgatggcgaccggcgcacgggtgcgtaacacgtatccaatctacccgtcacttggggataggctttcgaaagaaagattaatacccgatggtatgtccatgccgcatgacgtggacattaaagatttatcggtgtcgg

SEQ ID NO: 1392 - DNA, 225 bp, Unknown
  Encodes 16S rRNA from Clostridium XlVa
agagtttgatcatggctcaggatgaacgctggcggcgtgcctaacacatgcaagtcgaacggagatgtgcaccgaatgaggattcgtctgatttcaccgcgcatctgagtggcggatgggtgagtaacgcgtggataacctgcccttcactgggggataacaaccggaaacgggtgctaataccgcataggcgcacgaagtcgcatgactttgagcgtaaagatt

SEQ ID NO: 1393 - DNA, 225 bp, Unknown
  Encodes 16S rRNA from Clostridium IV
agagtttgatcctggctcaggatgaacgctggcggcgtgcctaatacatgcaagtcgaacggagcaccttggtgctcagtggcgaacgggtgaggagaacataggtaacctgcccctccgagggggacaacagctggaaacggctgctaagaccgcatagacgcattcagggcatcctggatgcgctaaatgaccggatggtcagcggggggatggacctatgca

SEQ ID NO: 1394 - DNA, 225 bp, Unknown
  Encodes 16S rRNA from Prevotella
agagtttgatcctggctcaggatgaacgctagcggcaggcctaacacatgcaagtcgaggggcagcgcgggatagcaatatcctggcggcgaccggcagaagggtgcgtaacgcgtgagcgacatgcccgtcaccgggggacaagcgctggaaacggcgtctaataccccatatgcctggggagtgcatgcttccttggtgaaagtttcgacggtgacggattgg

SEQ ID NO: 1395 - DNA, 225 bp, Unknown
  Encodes 16S rRNA from Mogibacterium
agagtttgatcatggctcaggatgaacgctggcggcgtgcctaatacatgcaagtcgagcgagaaattactttgacgcgttttcggacaagtctgtgtaatggaaagcggcggacgggtgagtaacgcgtaggcaacctgcccttagcagagggatagccattggaaacgatgattaaaacctcataatgctgcactaacacatgttagagcagccaaagattta

SEQ ID NO: 1396 - DNA, 225 bp, Unknown
  Encodes 16S rRNA from Prevotella
agagtttgatcatggctcaggatgaacgctagctacaggcttaacacatgcaagtcgaggggaaacgatatcgaaagcttgctttcgataggcgtcgaccggcgcacgggtgagtaacgcgtatccaacctgcctggaaatagggaataatccgtggaaacgcggcctaatgtcctatgtgctccgaagaggacatctgatttggagtaaagatttatcgtttcc

SEQ ID NO: 1397 - DNA, 225 bp, Unknown
  Encodes 16S rRNA from Clostridium XlVa
agagtttgatcatggctcaggatgaacgctggcggcgtgcttaatacatgcaagtcgaacggagatattccaccgagagaagctgagtgcttgcacaaggccaatctcaccggattatcttagtggcggacgggtgagtaacgcgtgggtaacctgccttatacaggggaataacagccagaaatgactgctaataccgcataagcgcacgagaccgcatggtca

SEQ ID NO: 1398 - DNA, 225 bp, Unknown
  Encodes 16S rRNA from Prevotella
agagtttgatcctggctcaggatgaacgctagctacaggcttaacacatgcaagtcgaggggaaacggtagtgggtggcttgccacccgctggacgtcgaccggcggatgggtgcgtaacgcgtatccaacctgccgcagtcccggggatagcccgtggaaacgcggattaacacccgatggtgcatacgttccgcatggcgcgtatgccaaatgcgaaggactg

SEQ ID NO: 1399 - DNA, 225 bp, Unknown
  Encodes 16S rRNA from Capnocytophaga
agagtttgatcctggctcaggatgaacgctagcggcaggcctaacacatgcaagtcgaggggcagcgcggtgcagcaatgcactggcggcgaccggcgcacgggtgcgtaacgcgtatgcaacccacccgcaacaggggtataacggagggaaacttccactaatcccccatattgccgtcatcccgcatggggaggcggcgaaagcttcggcggttgcggacgg

SEQ ID NO: 1400 - DNA, 225 bp, Unknown
  Encodes 16S rRNA from Acholeplasma
agagtttgatcatggctcaggatgaacgctggcggcgtgcctaatacatgcaagtcgaacgggagtgcttgcactccagtggcgaacgggtgagtaacacgtaggtaatctagcattaagacgaggatagcttctagaaatgggagataatactggataggaaattttcctgcatggggaaatttttaaagatttatcgcttaatggggagcctgcggtgcatta

SEQ ID NO: 1401 - DNA, 225 bp, Unknown
  Encodes 16S rRNA from Clostridium IV
agagtttgatcctggctcaggacgaacgctggcggcgtgcctaacacatgcaagtcgaacggagttattagagtgaagttttcggatggagcgataataacttagtggcggacgggtgagtaacgcgtgagtaacctgcccatcagagggggataacgttctgaaaagaacgctaataccgcataacatatttggttcgcatggactgaatatcaaaggagcaat

SEQ ID NO: 1402 - DNA, 225 bp, Unknown
  Encodes 16S rRNA from Succinivibrio
agagtttgatcatggctcagattgaacgctggcggcaggcctaatacatgcaagtcgaacggtaacatggaagtagcaatacttttgatgacgagtggcggacgggtgagtaatacgtagataatctgccttctagagggaaataacagagagaaatttctgctaatgtcccataagaccacactatggcatcttagagtgatcaaaggagtaatccgctagaag

SEQ ID NO: 1403 - DNA, 225 bp, Unknown
  Encodes 16S rRNA from Pseudonocardia
agagtttgatcctggctcaggacgaacgctggcggcgtgcttaatacatgcaagtcgagcgagctacttcggtagcgagcggcgcacgggtgagtaacgcgtagatgatctaccctcgagactgagatacctctgggaaactggagttaataccagataacgcacattggttggttctgatgtgttaaagcggtgcaagtcgcacttgaggatgagtctgcggcc

SEQ ID NO: 1404 - DNA, 225 bp, Unknown
  Encodes 16S rRNA from Clostridium XlVa
agagtttgatcctggctcaggatgaacgctggcggcgtgcttaacacatgcaagtcgaacggacatggcaccggagcagaagagttcgcttggacgctccaccgtcatgttagtggcggacgggtgagtaacgcgtgagcaaccaaccctatgcagggggataacagttagaaatgactgctaataccgcataagcccacagcatcgcatggtgcagggggaaaa

SEQ ID NO: 1405 - DNA, 225 bp, Unknown
  Encodes 16S rRNA from Butyricimonas
agagtttgatcctggctcaggatgaacgctagcgacaggcttaacacatgcaagtcgaggggcagcatggcggtagcaatactgctgatggcgaccggcgcactggtgagtaacacgtatgcaacctgccccgcgcagggggataatccggagaaatctggtctaataccccgtacgccgcgcttccgcatggtagtgcggtgaaaggagcgatccggcacggga

SEQ ID NO: 1406 - DNA, 225 bp, Unknown
  Encodes 16S rRNA from Anaerovorax
agagtttgatcctggctcaggatgaacgctggcggcgtgcctaacacatgcaagtcgagcgggaaatacagaacagaaggttcgctggaagttttgtatggagagcggcggacgggtgagtaacgcgtaggcaacctgccctttgcagagggatagccactggaaacggtgattaaaacctcataatgccattgattcacatgtttcgatggccaaagatttatc

SEQ ID NO: 1407 - DNA, 225 bp, Unknown
  Encodes 16S rRNA from Prevotella
agagtttgatcctggctcaggatgaacgctagctacaggcttaacacatgcaagtcgaggggtaacgtgagggaagcttgcttcccttgacgacgaccggcgaatgggtgagtaacgcgtatccaacctgccgcacgcccgggaacagcccttggaaacgaggattaaatcccgataccttatgctgctgcatggtggtataagaaaacaggcatgcgatgggga

SEQ ID NO: 1408 - DNA, 225 bp, Unknown
  Encodes 16S rRNA from Butyricimonas
agagtttgatcctggctcaggatgaacgctagcgacaggcttaacacatgcaagtcgaggggcagcatgagggtagcaataccttcgatggcgaccggcgcactggtgagtaacacgtatgcaacctgcccttgtcagggggataatccggggaaacccggtctaataccgcataacaccttggggggcctccccttaggttgaaagatacgtcggacagggatg

SEQ ID NO: 1409 - DNA, 225 bp, Unknown
  Encodes 16S rRNA from Parabacteroides
agagtttgatcatggctcaggatgaacgctagcgacaggcttaacacatgcaagtcgaggggcagcggggcgtggcaacacgccgccggcgaccggcgcactggtgagtaacacgtatgcaacctgcccatgagagggggataacccgtggaaacgcggactaataccccgtaagccggcgtgccgcatggcatgttggtgaaaggagcgatccgttcatggatg

SEQ ID NO: 1410 - DNA, 225 bp, Unknown
  Encodes 16S rRNA from Clostridium XlVa
agagtttgatcatggctcaggatgaacgctggcggcgtgcctaacacatgcaagtcgaacggagtaccaccggactgagattcgtcgaaggaaggtgactacttagtggcggacgggtgagtaacgcgtgggtaacctgcctcatagagggggacaacagttggaaacgattgctaataccgcataagcccgcagtaccgcatggtacagagggaaaagattcat

SEQ ID NO: 1411 - DNA, 225 bp, Unknown
  Encodes 16S rRNA from Clostridium XlVb
agagtttgatcatggctcaggatgaacgctggcggcgtgcttaacacatgcaagtcgaacgaagaggtgctgagggataggcttcggctttgaacacggcgcatatcttagtggcggacgggtgagtaacgcgtgggcaacctgccctttacaggggaataatcattggaaacgatgactaataccgcatgtcaccgtgagatggcatcattttacgggaaaagg

SEQ ID NO: 1412 - DNA, 225 bp, Unknown; identical to SEQ ID NO: 100
  Encodes 16S rRNA from Bacteroides

SEQ ID NO: 1413 - DNA, 225 bp, Unknown
  Encodes 16S rRNA from unknown taxa
agagtttgatcctggctcaggacgaacgctggcggcgtgcttcatacatgcaagtcgaacgagaagtcaccttcgggtgatggatagtggcggacgggtgagtaatgtgtagagaatctgccctagagagggggatagcagttggaaacgactattaataccccatatgcgcgtagttgcgatactattcgtgaaagattaatcgctctaggatgagtctgcatc

SEQ ID NO: 1414 - DNA, 225 bp, Unknown
  Encodes 16S rRNA from Riemerella
agagtttgatcatggctcaggatgaacgctagcgggaggcctaacacatgcaagccgagcggtagaaagtagcttgctacttttgagagcggcgtacgggtgcgtaacacgtgtgcaacctgcctttatctggagaatagcctttcgaaaggaagattaatgctccataacatattgaatggcatcatttaatattgaaagctgcggcggatagagatgggcacg

SEQ ID NO: 1415 - DNA, 225 bp, Unknown
  Encodes 16S rRNA from Anaeroplasma
agagtttgatcatggctcaggattaacgctggcggcgtgcctaatacatgcaagtcggatggttagcttgctaaccatggcgaacgggtgagtaacacgtaggtaacctgtcttttagccgaggataaccattggaaacgatggataatactggataggacatttgaaggcatctttagatgtttaaagatttatcactagaagaggggcctgcggcgcattagc

SEQ ID NO: 1416 - DNA, 225 bp, Unknown
  Encodes 16S rRNA from Ruminococcus
agagtttgatcctggctcaggacgaacgctggcggcgtgcctaacacatgcaagtcgaacggagctgaagagcttgcttttcagcttagtggcggacgggtgagtaacgcgtgagtaacctgcctccgagagtggaataacgttttgaaaagaacgctaataccgcataacgcacaagagtcgcatggctaaagtgccaaagatttcatcgctcggagatggact

SEQ ID NO: 1417 - DNA, 225 bp, Unknown
  Encodes 16S rRNA from unknown taxa
agagtttgatcctggctcagaacgaacgctggtagcgtggattaggcatgcaagtcgaacgggatcgcccgattagcaataaccgggcgtgagagtggcggattggggaggaacacgtgagcaacctgcccttgagttggggaaaaccgttggaaacgacggctaataccggatgtggcgcccgacgacatcgtcggagcgctaaagggggccgcaaggctcccg

SEQ ID NO: 1418 - DNA, 225 bp, Unknown
  Encodes 16S rRNA from Lachnospiracea incertae sedis
agagtttgatcctggctcaggatgaacgctggcggcgtgcttaatacatgcaagtcgaacgaagcacccctcccgatgatatgacgagcttgctctgaattgaatcacctggggtgactgagtggcggacgggtgagtaacgcgtgggtaacctacctatgacagggggatagcagttggaaacgactgataataccgcataagtgcacagtatcgcatgataca

SEQ ID NO: 1419 - DNA, 225 bp, Unknown
  Encodes 16S rRNA from Syntrophococcus
agagtttgatcctggctcaggatgaacgctggcggcgtgcctaacacatgcaagtcgaacgaggctcttttctttgaagtttcgaccgaaaagagaagatcaccgagtggcggatgggtgagtaacgcgtggagaacctacccttatcagggggataacaactggaaacggttgacaataccgcatatatgagcagaccgcatgatcagctcaggaaagatttat

SEQ ID NO: 1420 - DNA, 225 bp, Unknown
  Encodes 16S rRNA from Clostridium IV
agagtttgatcatggctcaggatgaacgctggcggcgtgcataacacattcaagtcgaacgaagcactttggacggaacccttcggggggaagactgatttgactgagtggcggacgggtgagtaacgcgtgagcaacctgccttgaagagggggataacacagggaaacttgtgctaataccgcataacatatcgtgatcgcatggtcgtggtatcaaagctcc

SEQ ID NO: 1421 - DNA, 225 bp, Unknown
  Encodes 16S rRNA from Barnesiella
agagtttgatcatggctcaggatgaacgctagcgacaggcctaacacatgcaagtcgaggggcagcgcgttggtagcaataccgatggcggcgaccggcgcacgggtgcgtaacaggtgtgcaatctgtccatagtcggaggatagcccgctgaaaggcggattaatactccatgtgagttgaagccgcatggttttaatttgaaacgcgaggactatggttgag

SEQ ID NO: 1422 - DNA, 225 bp, Unknown
  Encodes 16S rRNA from Olivibacter
agagtttgatcctggctcaggatgaacgctagcggcaggcttaacacatgcaagtcgaggggcagcgcgttgtagcaatacaatggcggcgaccggcggaagggtgcgtaacgcgtgagcaacctgcccctgtcagggggatagtcgatggaaacgtcgcgtaataccccgtacgatgcgtgaccgcatggtcgtgcattgaaagatttatcggacagggatggg

SEQ ID NO: 1423 - DNA, 225 bp, Unknown
  Encodes 16S rRNA from Clostridium XlVa
agagtttgatcatggctcaggatgaacgctggcggcgtgcttaatacatgcaagtcgaacgaagcactttttccggaagccctcgggccgaaggaagctgtgacttagtggcggacgggtgagtaacgcgtgggtaacctgcctcatacagggggacaacagttggaaacggctgctaataccccataagcgcacaacatcgcatggtgatgtgtgaaaagattt

SEQ ID NO: 1424 - DNA, 225 bp, Unknown
  Encodes 16S rRNA from Cryptanaerobacter
agagtttgatcatggctcaggacgaacgctggcggcgtgcttaacacatgcaagtcgaacggacgaatgtttttgcactcagtatgttgtaaaatatattgagtgcagaaatatgagttagtggcggactggtgagtaacgcgtgagcaacctgcctttaactggggaataccacttagaaataggtgctaataccgcataacattgcactgtggcatcacagag

SEQ ID NO: 1425 - DNA, 225 bp, Unknown
  Encodes 16S rRNA from Saccharofermentans
agagtttgatcatggctcaggacgaacgctggcggcgtgcctaacacatgcaagtcgagcggactttcatcaggaaggtgcttgcactggaaagatgagagttagcggcggacgggtgagtaacgcgtgagcaatctgtcccatacagggggataataccgcgaaagaggttctaataccgcatgagaccacggtgaggcatctcacaggggtcaaaggagcaat

SEQ ID NO: 1426 - DNA, 225 bp, Unknown
  Encodes 16S rRNA from Clostridium IV
agagtttgatcatggctcaggatgaacgctggcggcgtgcataacacattcaagtcgaacgaagcactgtcgaggaagtcttcggatggaattgactttgacttagtggcggacgggtgagtaacgcgtgagcaaccttcctggtagtgagggataacacagggaaacttgtgctaataccgcatgacgcatgattgtcgcatggcagacatgccaaagacatgt

SEQ ID NO: 1427 - DNA, 225 bp, Unknown
  Encodes 16S rRNA from Coprococcus
agagtttgatcatggctcaggatgaacgctggcggcgtgcttaacacatgcaagtcgaacggagtttagcgcttccgaagcttcggcagaggattgttaaacttagtggcggacgggtgagtaacgcgtgggtaacctgccatgtacagggggataacacttagaaataggtgctaataccgcataagcgcacatgatcgcatgatcaggtgtgaaaaactgagg

SEQ ID NO: 1428 - DNA, 225 bp, Unknown
  Encodes 16S rRNA from Barnesiella
agagtttgatcctggctcaggatgaacgctagcgacaggcctaacacatgcaagtcgaggggcagcgggagtgaagcttgcttcacttgccggcgaccggcgcacgggtgagtaacgcgtatgcaacctgcctgtaacagggggataacccggagaaatccggactaagaccgcataacgctgagaagccgcatgacttttcagccaaatattcataggttacag

SEQ ID NO: 1429 - DNA, 225 bp, Unknown
  Encodes 16S rRNA from Clostridium sensu stricto
agagtttgatcatggctcaggacgaacgctggcggcgtgcctaacacatgcaagtcgagcggagacatatcacggaaggattcgtccggaaggggtatgtttgagcggcggacgggtgagtaacgcgtgatgaacctgtccttcacagggggataagacatcgaaaggtgttctaataccgcataggaccacggtaccgcatggtacaggggtgaaaggagcgat

SEQ ID NO: 1430 - DNA, 225 bp, Unknown
  Encodes 16S rRNA from Hydrogenoanaerobacterium
agagtttgatcatggctcaggagaaacgctggcggcgcacataagacatgcaagtcgaacggaatttagccaaatgtttacatgaggcgaagatttagtggcggacgggtgagtaacacgtgagcaacctaccttgaagagggggataacattgagaaatcagtgctaataccgcataacacttcatattcacatgaataagaagtcaaaggagaaatccgcttt

SEQ ID NO: 1431 - DNA, 225 bp, Unknown
  Encodes 16S rRNA from Clostridium XlVb
agagtttgatcatggctcaggatgaacgctggcggcgtgcttaacacatgcaagtcgagcgaagttattagagcttgctttgataacttagcggcggacgggtgagtaacgcgtgggtaacctgccctgtacagaggaataacagttagaaatgactgctaatacctcataagccgacggaatggcatcattttgtcggaaaagatttatcggtacaggagggac

SEQ ID NO: 1432 - DNA, 225 bp, Unknown
  Encodes 16S rRNA from Selenomonas
agagtttgatcctggctcaggacgaacgctggcggcgtgcttaacacatgcaagtcgaacggagctgaatagcttgctatgaaagcttagtggcaaacgggtgagtaacgcgtgggcaacctgccggaaagatggggacaacatcccgaaaggggtgctaataccgaatgttgtatatagagcgcatgctctgtatattaaaggatactatccgctttccgatgg

SEQ ID NO: 1433 - DNA, 225 bp, Unknown
  Encodes 16S rRNA from Prevotella
agagtttgatcctggctcaggatgaacgctggcggcgtgcctaacacatgcaagtcgaggggcatcaggacggtagcttgctatcgttgctggcgaccggcgcacgggtgagtaacgcgtatccaaccttcccatgactccggttcagcccgccgaaaggcggattactcccggatggtttccgaagagggcatctgatttggaataaagattgatcggtcatgg

SEQ ID NO: 1434 - DNA, 225 bp, Unknown
  Encodes 16S rRNA from Hydrogenoanaerobacterium
agagtttgatcatggctcaggacgaacgctggcggcgcgcctaacacatgcaagtcgaacgggactagtgaccggaggatagatgaagtttatcttgcgatcactagttcagtggcggacgggtgagtaaagcatgagcaacttgcctgatagagggggatagcttttggaaacagaagataataccgcatacttcaaaagtttcgcatggagtttttggaaaag

SEQ ID NO: 1435 - DNA, 225 bp, Unknown
  Encodes 16S rRNA from Spirochaeta
agagtttgatcctggctcagaacgaacgctggcggcgcgtcttaagcatgcaagtcgagcggtaacttaccttcgggtaagctagagcggcggactggtgagtaacacgtgggtgacataccctccggatcgggatagctcctagaaataggagataataccgggtacgaccactacggtcagagcgtagtgaggaaaggtgcattagcaccgccggaggagtgg

SEQ ID NO: 1436 - DNA, 225 bp, Unknown
  Encodes 16S rRNA from Enterorhabdus
agagtttgatcatggctcaggatgaacgctggcggcgtgcttaacacatgcaagtcgaacgattaacccgccttcgggcggtcatagagtggcgaacgggtgagtaacacgtgaccaacctgccccgcgcaccgggacagcctcgcgaaagcgggattaataccggatactccgcaccccccgcatggggggtgcgggaaagctccggcggcgcgggatggggtc

SEQ ID NO: 1437 - DNA, 225 bp, Unknown
  Encodes 16S rRNA from Thermoanaerobacter
agagtttgatcctggctcaggatgaacgctggcggcgcgcctaacacatgcaagtcgagcggcgaaggggattcgtccccggaccagcggcgaacgggtgagtaacgcgtgggcaacctgccccgggcccggggatagcggggggaaacccccggtaagacccgacgcgcccggaggggggcatccccctccgggcgaaggagacggcccgggatgggcccgcgt

SEQ ID NO: 1438 - DNA, 225 bp, Unknown
  Encodes 16S rRNA from unknown taxa
agagtttgatcatggctcaggacgaacgctagcgacgtgtctaagaaatgcaagtcgggcgatgacggaggcttcggcctcccgattagcggcgaacggtcgcgtaacacgtaagcaatctgccccaaagttcgggatagcccggcgaaagtcggattaataccggatgtggatgtttttgcgcatgcatttgcatctaaagcagcgatgcgctttgggatgagc

SEQ ID NO: 1439 - DNA, 225 bp, Unknown
  Encodes 16S rRNA from Syntrophococcus
agagtttgatcatggctcaggatgaacgctggcggcgtgcttaacacatgcaagtcgaacgggaactctgaactgaaggttcgctggatgtttagaaattctagtggcggacgggtgagtaacgcgtgggtaacctgcctataagacgtgaacaacagttagaaatgactgctaatacacgataagcacacagtattgcatgatacagtgtgaaaagaatttcgc

SEQ ID NO: 1440 - DNA, 225 bp, Unknown
  Encodes 16S rRNA from Sphingobium
agagtttgatcatggctcagagtgaacgctagcggaatgctttatacatgcaagtcgaacggagttttattgtgaagtagcaatatggaatagtaaaacttagtggcgaactggcgagtaatagttaggaacttaccgagtagtgggggacaacagttagaaatgactgctaataccgcatacgcccgagaggggaaagatttatcgctatttgagaggcctaac

SEQ ID NO: 1441 - DNA, 225 bp, Unknown
  Encodes 16S rRNA from Clostridium XlVa
agagtttgatcatggctcaggatgaacgctggcggcgtgcctaacacatgcaagtcgaacgaagctcactttttgaattcttcggaaggaaaaaagagaagacttagtggcggacgggtgagtaacgcgtgggtaatctgccctgtacagggggacaacagttagaaatgactgctaataccgcataagcgtacggtaccgcatggtacagtacgaaaaactgag

SEQ ID NO: 1442 - DNA, 225 bp, Unknown
  Encodes 16S rRNA from Geosporobacter
agagtttgatcctggctcaggatgaacgctggcggcgtgcctaacacatgcaagtcgagcgggaatctcctgattgaaacttcggtagatagacggagaggatagcggcggacgggtgagtaacgcgtaggtaagctgccctatgcacagggatagcctagggaaacctggattaatacctgatgacgctgcgaggtcacatggccatgcagccaaagtttttcg

SEQ ID NO: 1443 - DNA, 225 bp, Unknown
  Encodes 16S rRNA from Enterorhabdus
agagtttgatcatggctcaggatgaacgctggcggcgtgcctaacacatgcaagtcgaacggttaagccggcttcggccgggcatacagtggcgaacgggtgagtaacacgtgaccaacctgccccgcgcaccgggacagccccccgaaagggggattaataccggatactccgcctcccccgcatgaggggggcgggaaagctccggcggcgcgggatggggtc

SEQ ID NO: 1444 - DNA, 225 bp, Unknown
  Encodes 16S rRNA from unknown taxa
agagtttgatcctggctcagaacgaacgctggtagcgtggattaggcatgcaagtcgaacgggatccgggaggtagcaatacttcctggtgagagtggcggattggggaggaacacgtgagcaacctgcctttgagtcggggaaaaccgttggaaacgacggctaataccggatgtggcgcccggtgacatcactggagcgctaaagggggccgcaaggctctcg

SEQ ID NO: 1445 - DNA, 225 bp, Unknown
  Encodes 16S rRNA from Clostridium XlVa
agagtttgatcctggctcaggatgaacgctggcggcgtgcctaacacatgcaagtcgaacggagtacagacgctgtgagaggaagtgcttgcacagacttgaacttgtttgtacttagtggcggacgggtgagtaacgcgtggaaaacctgcctcatacagggggataacagggagaaattcctgctaataccgcataagcgcacggaaccgcatggttcagtgt

SEQ ID NO: 1446 - DNA, 225 bp, Unknown
  Encodes 16S rRNA from Parabacteroides
agagtttgatcctggctcaggatgaacgctagcgacaggcttaacacatgcaagtcgaggggcagcgcggcgtgagcaatcatgctggcggcgaccggcgcactggtgagtaacacgtatgcaacctgccccctgccggggaataaaccagggaaacttggcctaatgccgcataacacgccttccggcatcggtaggcgttgaaagctccggcggcaggggatg

SEQ ID NO: 1447 - DNA, 225 bp, Unknown
  Encodes 16S rRNA from Cryptanaerobacter
agagtttgatcatggctcaggacgaacgctggcggcgtgcttaatacatgcaagtcgaacggatatgtagcaatacatattagtggcggacgggtgagtaacgcgtaatcaacctgccttttacaggggaataacacttggaaacaggtgctaataccgcatatgaccacaacacggcatcgtgaaggggtaaaagttttatcggtaaaagagggggttgcgtat

SEQ ID NO: 1448 - DNA, 225 bp, Unknown
  Encodes 16S rRNA from Anaeroplasma
agagtttgatcctggctcaggattaacgctggcggcgtgcctaatacatgcaagtcgaatggttagcttgctaaccatggcgaacgggtgagtaacacgtaggcaacctgactataagacgaggataaccattggaaacgatggataatactggataggatatagatgggcatccatttatatttaaagatttatcacttaatgaggggcctgcggcgcattagc

SEQ ID NO: 1449 - DNA, 225 bp, Unknown
  Encodes 16S rRNA from Spirochaeta
agagtttgatcatggctcagaacgaacgctggcggcgcgtcttaagcatgcaagtcgggcggcaagctgccttcgggcagcctagagcggcggactggtgagtaacgcgtgggtgacgcacccccttgacggggacagcccgcagaaatgcggggtaataccggataaggtccccggggttggagcccggggaggaaaggagctattgctccgcgaggggagcgg

SEQ ID NO: 1450 - DNA, 225 bp, Unknown
  Encodes 16S rRNA from Prevotella
agagtttgatcatggctcaggatgaacgctagctacaggcttaacacatgcaagtcgaggggcagcgggagagtagcttgctactcttgccggcgaccggcgaatgggtgagtaacgcgtatccaacctgccacatgcccgggaatagcccttggaaatgaggattaagtcccgatatgcttatttgtcgcatgacatgtaagtgaaacaggcatgtgatgggga

SEQ ID NO: 1451 - DNA, 225 bp, Unknown
  Encodes 16S rRNA from Roseburia
agagtttgatcatggctcaggatgaacgctggcggcgtgcttaacacatgcaagtcgaacggactctaagtagaaagcggagcttgctccaatggaaatttagagttagtggcggacgggtgagtaacgcgtgggtaacctgccttgcacagggggacaacagttggaaacgactgctaataccgcataagccggtagtgccgcatggcacattcggaaaagatt

SEQ ID NO: 1452 - DNA, 225 bp, Unknown
  Encodes 16S rRNA from Pedobacter
agagtttgatcctggctcaggatgaacgctagcggcaggcctaatacatgcaagtcgaacggtaagcggtccttcgggactgtgagagtggcggacgggtgcgtaacgcgtatgcaaccaacccccgacgggcggatagccggtggaaacgccggataagccgccatgcggccgaggaggggcatccctctttggtcaaagcggagacgcggtgggggacgggca

SEQ ID NO: 1453 - DNA, 225 bp, Unknown
  Encodes 16S rRNA from Pedobacter
agagtttgatcatggctcaggatgaacgctagcggcaggcctaacacatgcaagtcgaggggcagcgcggtgcagcaatgcactggcggcgaccggcgcacgggtgcgtaacgcgtatgcaacccacccgcaacaggggtataacggagggaaacttccactaatcccccatattgccgtctttccgcatgggggggcggcgaaagcttcggcggttgcggacgg

SEQ ID NO: 1454 - DNA, 225 bp, Unknown
  Encodes 16S rRNA from Eggerthella
agagtttgatcctggctcaggatgaacgctggcggcgtgcttaacacatgcaagtcgaacgagaacgcaccttcgggtgctagtagagtggcgaacgggtgagtaacacgtgagcaacctgccttccacttcgggataacccagggaaacctgtgctaataccgaatactccgggacctccgcatgggggacccgggaaagcgcatacggtggaagatgggctcg

SEQ ID NO: 1455 - DNA, 225 bp, Unknown
  Encodes 16S rRNA from Prevotella
agagtttgatcctggctcaggatgaacgctagctacaggcttaacacatgcaagtcgaggggcagcatgaagtttgcttgcaaactttgatggcgaccggcgcacgggtgagtaacgcgtatccaacctgcccattacccggggatagcccgccgaaaggcgaattaatacccgatgtggtcccatgacggcatcagagtgggaccaaagtcttgtcggtaacgg

SEQ ID NO: 1456 - DNA, 225 bp, Unknown
  Encodes 16S rRNA from Rikenella
agagtttgatcctggctcaggatgaacgctagcggcaggcttaacacatgcaagtcgaggggcagcgcggagtagcaatactctggcggcgaccggcgcacgggtgcgtaacgcgtatgcaacctgcctgcgacagggggataacctggagaaattcggactaataccccataccacgcctggcggcatcgccgggcgttgaaaggagcgatccggtcgcagatg

SEQ ID NO: 1457 - DNA, 225 bp, Unknown
  Encodes 16S rRNA from Anaerophaga
agagtttgatcctggctcaggatgaacgctagcgacaggcttaacacatgcaagtcgaggggcagcgagtggcgttgttcgcaacgccatgtcggcgaccggcgcactggtgagtaacacgtatgcaacctgcccttcaccggggcataacccttggaaacgaggcctaattccccatatacagcattcgggcatccgtgagctgtgaaaggtttattccggtga

SEQ ID NO: 1458 - DNA, 225 bp, Unknown
  Encodes 16S rRNA from Spirochaeta
agagtttgatcctggctcagaacgaacgctggcggcgcgtcttaagcatgcaagtcgggcggcaagctgccttcgggcagcctagagcggcggactggtgagtaacgcgtgggtgacgcacccccttgacggggacagcccgcagaaatgcggggtaataccggataaggtccccggggccggagcccggggaggaaaggagctattgctccgcgaggggagcgg

SEQ ID NO: 1459 - DNA, 225 bp, Unknown
  Encodes 16S rRNA from Clostridium IV
agagtttgatcctggctcaggagaaacgctggcggcgcacataagacatgcaagtcgaacggaatttagccgaatgtttacatgaggcgaagatttagtggcggacgggtgagtaacacgtgagcaacctaccttagagagggggataacattgagaaatcagtgctaataccgcataacactatagtaccacatggtacattagtcaaaggagaaatccacttt

SEQ ID NO: 1460 - DNA, 225 bp, Unknown
  Encodes 16S rRNA from Weissella
agagtttgatcatggctcaggatgaacgctggcggcgtgcctaatacatgcaagtcgaacgctttgtgcttaattgatatgatgagcttgctctgatttgattttttgatttcaaagagtggcgaacgggtgagtaacacgtgggtaacctacctcttagcaggggataacatttggaaacaagtgctaataccgtataatatcaacaaccgcatggttgttgat

SEQ ID NO: 1461 - DNA, 225 bp, Unknown
  Encodes 16S rRNA from Butyricicoccus
agagtttgatcctggctcaggataaacgctggcggcgcacataagacatgcaagtcgaacgggaactttgttgaagttatctgatataaagttctagtggcggactggtgagtaatgtataagcaacctgcctacaagaggggaataacagtgagaaatcattgctaataccgcataagctgtgagaatggcatcattcaaacagaaaaggaagcaattctgctt

SEQ ID NO: 1462 - DNA, 216 bp, Unknown
  Encodes 16S rRNA from Hahella
agagtttgatcatggctcaggatgaacgctagcggcaggcttaacacatgcaagtcgagcgggaactctgatgcagccatgccgcgtgtgtgaagaaggccttcgggttgtaaagcactttagttttcgagaaagggtgctgttctaatagggcagtattcagatgttagaaaaagaataagtaccggcaaactccgtgccagcagccgcggtaat

SEQ ID NO: 1463 - DNA, 225 bp, Unknown
  Encodes 16S rRNA from Acholeplasma
agagtttgatcctggctcaggatgaacgctggcggcgtgcctaatacatgcaagtcgtacgctaaacttcggtttagagtggcgaacgggtgagtaacacgtaggtaacctgcccataagacgaggataactactggaaacggtagctaatactggatagtatatagaatcgcatgattttatatttaaagatgcgtttgcatcacttatggatggacctgcggc

SEQ ID NO: 1464 - DNA, 225 bp, Unknown
  Encodes 16S rRNA from Clostridium XlVa
agagtttgatcctggctcaggatgaacgctggcggcgtgcctaacacatgcaagtcgaacgaagaccccgaggcggagatttcggtcaaagccaagggaggactgagtggcggacgggtgagtaacgcgtggataacctgccccatacagggggatagcagttggaaacgactgataataccgcataagcgcacaagggagacatcttccagtgtgaaaagattt

SEQ ID NO: 1465 - DNA, 225 bp, Unknown
  Encodes 16S rRNA from Cellulosilyticum
agagtttgatcatggctcaggacgaacgctggcggcgtgcttaacacatgcaagtcgaacggagcgtacggacggaagttttcggacggaagactgtacgcttagtggcggacgggtgagtaacgcgtgagcaatctgcccataagagggggacaacagccggaaacagctgctaataccgcatgagaccacattaccgcatggtagaggggtcaaagaaattcg

SEQ ID NO: 1466 - DNA, 225 bp, Unknown
  Encodes 16S rRNA from unknown taxa
agagtttgatcatggctcagaacgaacgctggtagcgtggattaggcatgcaagtcgaacgggatccatgaagtagcaatacggattggtgagagtggcggaagggcgaggaacacgtgagcaacctgtccttgaggtggggaaaaccgttggaaacgacggctaataccgaatgtggcgcccggagacatctccggagcgctaaagggggccgcaaggctctcc

SEQ ID NO: 1467 - DNA, 225 bp, Unknown
  Encodes 16S rRNA from Clostridium XlVa
agagtttgatcctggctcaggatgaacgctggcggcgtgcctaacacatgcaagtcgaacggtgaaacagaagcggaggttttcggactgaagcatttgtggaacagtggcggacgggtgagtaacgcgtggataacctgccccatacagggggatagcagttggaaacgactgataataccgcataagcgcacagcaccacatggtggagtgtgaaaaactatt

SEQ ID NO: 1468 - DNA, 225 bp, Unknown
  Encodes 16S rRNA from Pseudoflavonifractor
agagtttgatcatggctcaggacgaacgctggcggcgtgcttaacacatgcaagtcgaacgaggaatgttaaaaagcttgctttttaacatttcgagtggcggacgggtgagtaacgcgtgaggaacctgtcttctacagggggataacgtcccgaaagggacgctaataccgcataagaccacggtgccgcatggcacaggggtcaaaggaggaatccggtaga

SEQ ID NO: 1469 - DNA, 225 bp, Unknown
  Encodes 16S rRNA from Calditerricola
agagtttgatcatggctcagaatgaacgctggcggcatggattaggcatgcaagtcgaacgggatccctcgggatctagtggcgaaagggtgagtaacacgtgagcaacctgcccccaaggccggaataagcactggaaacggtgtctaaaaccggatgaggcctctgtccacatggacagtcagccaaatattcataccctggggatgggctcgcggcccatta

SEQ ID NO: 1470 - DNA, 225 bp, Unknown
  Encodes 16S rRNA from Clostridium IV
agagtttgatcatggctcaggacgaacgctggcggcgtgcctaacacatgcaagtcgagcggagacatacgacggagaggaagttttcggatggaatcaaagatgtatgttttagcggcggacgggtgagtaacgcgtgagcaacctgtccctcacagggggataacacaccgaaaggtgtactaataccgcatgacactgacttgagacatcttgagacagtca

SEQ ID NO: 1471 - DNA, 225 bp, Unknown
  Encodes 16S rRNA from Clostridium IV
agagtttgatcctggctcaggacgaacgctggcggcgtgcttaacacatgcaagtcgaacgagaatctgtggaaggagttttcggacaacggaaacagaggaaagtggcggacgggtgagtaacgcgtgaggaacctgccttggagagggggacaacagctggaaacggctgctaataccgcatgatgcacgatggggacatccctgacgtgccaaagatttatc

SEQ ID NO: 1472 - DNA, 225 bp, Unknown
  Encodes 16S rRNA from Adlercreutzia
agagtttgatcatggctcaggatgaacgctggcggcgtgcttaacacatgcaagtcgaacggttaaaccggcttcggccggacatagagtggcgaacgggtgagtaacacgtgaccaacctgccccgcgcaccgggacagcctcgcgaaagcgggattaataccggatactccggcggcgcgggatggggtcgcggcccatcaggtagtaggtcgggtaggggcc

SEQ ID NO: 1473 - DNA, 225 bp, Unknown
  Encodes 16S rRNA from Bulleidia
agagtttgatcatggctcaggatgaacgctggcggcgtgcctaatacatgcaagtcgaacgagagcgaccagcttgctggtcaatcgagtggcgaacgggtgagtaacacataaacaatctgccctgaagactgggataacgtagggaaacccacgctaataccggataggcagtgagggggcatcctcttactgttaaagctgggctacagcactgcaggatga

SEQ ID NO: 1474 - DNA, 225 bp, Unknown
  Encodes 16S rRNA from Lachnospiracea incertae sedis
agagtttgatcctggctcaggatgaacgctggcggcgtgcctaacacatgcaagtcgagcggagtaagacaccgaatgaggatccgtctgatttcaccgtcttacttagcggcggatgggtgagtaacgcgtggacaacctgcccttcactgggggataacaaccggaaacgggtgctaataccgcatgggcgcgaacgaccgcatgatcgatcgcgtaaagatt

SEQ ID NO: 1475 - DNA, 225 bp, Unknown
  Encodes 16S rRNA from Mucilaginibacter
agagtttgatcatggctcaggatgaacgctggcggcaggcctaatacatgcaagtcggacggcagcatgccgtagcaatacggtgatggcgagtggcgtacgggtgcgtaacacgtgtgcaacctgccccgcacagggacaaaacgccgggaaactggcgctaatatcccatgacgccgcgctggggcatccctttgcggctaaagaggcgactcggtgcgggat

SEQ ID NO: 1476 - DNA, 225 bp, Unknown
  Encodes 16S rRNA from Victivallis
agagtttgatcctggctcagaacgaacgctggcggcatggattaggcatgcaagtcgaacggaagcagcaatgcttcagtggcggaagggtgaggaacgcgtgagtaatctgccctcaagttgggaataacagttggaaacgactgctaataccgaatgtggctgtaatttcgcatgaagttatggttaaagatttattgcttgaggatgagctcgcgtcccatt

SEQ ID NO: 1477 - DNA, 225 bp, Unknown
  Encodes 16S rRNA from Anaerovorax
agagtttgatcatggctcaggatgaacgctggcggcgtgcctaacacatgcaagtcgagcgggaaatcgctgattgagatttcggttgattgaagcgatggatagcggcggacgggtgagtaacgcgtaggtaatctgccttcagcacagggatagcctagggaaacctggattaatacctgataacgcattgaagtcacatggctttgatgccaaagatttatc

SEQ ID NO: 1478 - DNA, 225 bp, Unknown
  Encodes 16S rRNA from Clostridium XlVb
agagtttgatcctggctcaggatgaacgctggcggcgtgcttaacacatgcaagtcgagcgaagtttattgagcttgcttaataaacttagcggcggacgggtgagtaacgcgtgggtaacctgccctgtacagaggaataacagttagaaatgactgctaatgcctcataagccgacggaatggcatctttcagtcggaaaagatttatcggtacaggagggac

SEQ ID NO: 1479 - DNA, 225 bp, Unknown
  Encodes 16S rRNA from Clostridium XlVa
agagtttgatcatggctcaggatgaacgctggcggcgcatttaagacatgcaagtcgaacgaaaaaatttaatctaaacggaattgaagaattatctgataagaagttttaaccgaattttttagtggcggacgggtgagtaatacatagataatctgccttttagagggaaataactactggaaacggtagataatgtcccataagaccacactaccgcatgat

SEQ ID NO: 1480 - DNA, 225 bp, Unknown
  Encodes 16S rRNA from Prevotella
agagtttgatcctggctcaggatgaacgctagcggcaggcttaacacatgcaagtcgaggggcagcgggctgtagcaatacggtgccggcgaccggcggacgggtgcgtaacgcgtatgcaacctgcccggcacaggggaatagcccggcgaaagccggagtaatgccccatggttccagcatcccgcatggggagctggataaacccgcgagggggtgccggat

SEQ ID NO: 1481 - DNA, 225 bp, Unknown
  Encodes 16S rRNA from Bacteroides
agagtttgatcatggctcaggatgaacgctagcgacaggcctaacacatgcaagtcgaggggcagcacgaaggaagcttgctttctttggtggcgaccggcgcacgggtgcgtaacgcgtatgcaacctgtccataaccgagggatagcctcccgaaagggagattaaaacttcatgtgccacatgagggcatccgagagtggtgaaacgttacgggttatggtt

SEQ ID NO: 1482 - DNA, 225 bp, Unknown
  Encodes 16S rRNA from Schwartzia
agagtttgatcctggctcaggacgaacgctggcggcgtgcttaacacatgcaagtcgaacggggcgatttgaaagcttgcttttgatgagcctagtggcaaacgggtgagtaacgcgtaggcaacctgccctcaggatggggacaacggcccgaaaggaccgctaataccgaatgacgtatctttttcgcatggaagagataccaaaggcggagcaatccgtcac

SEQ ID NO: 1483 - DNA, 225 bp, Unknown
  Encodes 16S rRNA from Pyramidobacter
agatttgatcctggctcaggatgaacgctggcggcgtgcttaacacatgcaagttgcgcggggatctgatgatgagacttcggtggatttgttagatcctagcggcggacgggtgagtaaagcacaaggacgtgtccgagcgagggggacaactgcgggaaaccgtagctaataccccgtaagccgagaggtgaaagcagcaatgcgcgagcggagcgacttgtg

SEQ ID NO: 1484 - DNA, 225 bp, Unknown
  Encodes 16S rRNA from Eubacterium
agagtttgatcctggctcaggacgaacgctggcggcgtgcctaacacatgcaagtcgaacgaagcttgatttcagatttcttcggaaagacgaatgatatgactgagtggcggacgggtgagtaacgcgtgagcaacctgccctttggatcgggatagcgtttggaaacgaacggtaataccgaataaagtatttggatggcatcatctgaataccaaagctccg

SEQ ID NO: 1485 - DNA, 225 bp, Unknown
  Encodes 16S rRNA from Lachnospiracea incertae sedis
agagtttgatcatggctcaggatgaacgctggcggcgtgcctaacacatgcaagtcgaacgaagacatgcggacggaatcctccgggaggaaggctgcatggactgagtggcggacgggtgagtaacgcgtgggtaacctgccctgtacagggggacaacagttggaaacgactgctaataccgcataagcatacaggaccgcatggtccggtatgaaaaactcc

SEQ ID NO: 1486 - DNA, 225 bp, Unknown
  Encodes 16S rRNA from Clostridium XlVa
agagtttgatcatggctcaggatgaacgctggcggcgtgcttaacacatgcaagtcgaacgaggcttaacgaatgagatcttcggatggattttgttaatccgagtggcggacgggtgagtaacgcgtgggtaacctgccttacacagggggacaacagccggaaacggctgctaataccgcataacccgctagggccgcatggcccggacggaaaagatttatc

SEQ ID NO: 1487 - DNA, 225 bp, Unknown
  Encodes 16S rRNA from Roseburia
agagtttgatcctggctcaggatgaacgctggcggcgtgcttaacacatgcaagtcgaacgaagcacatggacggaattccttcggggaggaagaccatgtgactgagtggcggacgggtgagtaacgcgtgggtaacctacctcatacagggggataacagctggaaacggctgttaataccgcataagcgcacagggccgcatggtccggtgtgaaaaactcc

SEQ ID NO: 1488 - DNA, 225 bp, Unknown
  Encodes 16S rRNA from Clostridium XlVb
agagtttgatcatggctcaggatgaacgctggcggcgtgcttaacacatgcaagtcgaacgagagaagacgaaaagcttgctttttgtcctatcgagtggcggacgggtgagtaacgcgtgagtaacctgccccatactggggaataacgtttggaaacggacgctaataccgcataagcaggcggagggacatccctcagtttgaaaagatttatcggtatggg

SEQ ID NO: 1489 - DNA, 225 bp, Unknown
  Encodes 16S rRNA from Enterorhabdus
agagtttgatcctggctcaggatgaacgctggcggcgtgcctaacacatgcaagtcgaacggttaaaccgccctcgggcggacatagagtggcgaacgggtgagtaacacgtgaccaacctgccccgcgcaccgggacaaccgctggaaacggcggctaataccgggtactccggagggggcgcatgcccccgccgggagagctccggcggcgcgggatggggtc

SEQ ID NO: 1490 - DNA, 225 bp, Unknown
  Encodes 16S rRNA from Pedobacter
agagtttgatcctggctcaggatgaacgctagcggcaggcctaatacatgcaagtcgaacggtaaatgtcccttcggggacatgagagtggcggacgggtgcgtaacgcgtatgcaaccaacccccctcaccgggatagccggtggaaacgccggataagaccggatgcgcccatggggaggcatctccctgcgggcaaggcggcgacgcggagggggacgggca

SEQ ID NO: 1491 - DNA, 225 bp, Unknown
  Encodes 16S rRNA from Clostridium sensu stricto
agagtttgatcatggctcaggacgaacgctggcggcgtgcttaacacatgcaagtcgaacgagacttaagagcggaagtcttcggatggaaggtcataagtcgagtggcggacgggtgagtaacgcgtgagcaacctgtcttatacagggggataacactccgaaaggagcgctaataccgcataagaccacgatgccgcatggtatcggggtaaaaggagcgat

SEQ ID NO: 1492 - DNA, 225 bp, Unknown
  Encodes 16S rRNA from Clostridium XlVa
agagtttgatcatggctcaggatgaacgctggcggcgtgcttaacacatgcaagtcgaacggacttaggccaccgaactgaatttagcttgctattgaaggttcaccggtctaagttagtggcggacgggtgagtaacgcgtgggcaacctgcctttatccgggggataacagttagaaatgactgctaataccgcataagcgcacgaggaggcatctccttgtg

SEQ ID NO: 1493 - DNA, 225 bp, Unknown
  Encodes 16S rRNA from Clostridium III
agagtttgatcatggctcaggacgaacgctggcggcgcgcctaacacatgcaagtcgaacgggactagtgaccggagaatagatgaggttatctattttgcgatcactagttcagtggcggacgggtgagtaaagcatgagcaacctggctactagagggggatagcttttggaaacagaagataataccgcatacatcaaagatttcgcatgagatttttggaa

SEQ ID NO: 1494 - DNA, 225 bp, Unknown
  Encodes 16S rRNA from Desulfotomaculum
agagtttgatcatggctcaggacgaacgctggcggcgtgcttaatacatgcaagtcgaacggaagtaaagatttcggtttttactttagtggcgaacgggtgagtaacgcgtgaacaacctgactcgaagagggggataacaacgggaaactgttgctaataccgcataagaccacagaaccgcatgattcaggggtcaaagatttatcgctttgagaggggttc

SEQ ID NO: 1495 - DNA, 225 bp, Unknown
  Encodes 16S rRNA from Clostridium IV
agagtttgatcctggctcaggacgaacgctggcggcgtgcctaacacatgcaagtcgaacggaagcgtacattagaagttttcggatggaagatatacgttttagtggcggacgggtgagtaacgcgtgagtaacctgcctttcagagggggataacgttttgaaaagaacgctaataccgcataacgtaaaggagtcgcatggcttcattaccaaaggagcaat

SEQ ID NO: 1496 - DNA, 225 bp, Unknown
  Encodes 16S rRNA from Proteiniclasticum
agagtttgatcatggctcaggacgaacgctggcggcgtgcttaacacatgcaagtcgaacgagggatgggggagagcttgctctttttcattccgagtggcggacgggtgagtaacgcgtgaggaacctgtctttcacagggggataacgtaccgaaagggacgctaataccgcataagaccacagcaccgcatggtgaaggggtcaaaggaggaatccggtgga

SEQ ID NO: 1497 - DNA, 225 bp, Unknown
  Encodes 16S rRNA from Prevotella
agagtttgatcatggctcaggatgaacgctagctacaggcttaacacatgcaagtcgaggggcagcatgggagttgcttgcaacttctgatggcgaccggcgcacgggtgagtaacgcgtatccgaccttcccccaggtagggaacagcccggcgaaagtcggattaatgccctatagtctgcgaattgcgcatgttgtttgcagtaaagatttatcgccttggg

SEQ ID NO: 1498 - DNA, 225 bp, Unknown
  Encodes 16S rRNA from Faecalibacterium
agagtttgatcctggctcaggatgaacgctggcggcgtgcataacacattcaagtcgaacggagttgcgatggaaagaggcttcggccaatggaagttgtaacttagtggcggacgggtgagtaacgcgtgagcaacctacctatgcgcgggggacaacagttggaaacgactgctaataccgcataaatcatggtaaaggcatctttatcatggcaaagattaa

SEQ ID NO: 1499 - DNA, 225 bp, Unknown
  Encodes 16S rRNA from Microbacterium
agagtttgatcatggctcaggatgaacgctggcggcgtgcttaacacatgcaagtcgaacgatgaagctggagcttgctctggtggattagtggcgaacgggtgagtaacacgtgagcaacctgcccctgactctgggataacagccggaaacggctgctaataccggatatgcaccatgaacgcatgttctgtggtgggaaagatttttcggttggggatgggc

SEQ ID NO: 1500 - DNA, 225 bp, Unknown
  Encodes 16S rRNA from Leucobacter
agagtttgatcctggctcaggacgaacgctggcggcgtgcttaacacatgcaagtcgaacgatgaagcccagcttgctgggtggaagagtggcgaacgggtgagtaacacgtgagtaacctgcccttgactctgggataagcgctggaaacggcgtctaatactggatacgacctatcaccgcatggtgtgtgggtggaaagatttatcggttttggatggactc

SEQ ID NO: 1501 - DNA, 225 bp, Unknown
  Encodes 16S rRNA from Prevotella
agagtttgatcctggctcaggatgaacgctagctacaggcttaacacatgcaagtcgaggggtaacatgattggagcttgctctgattgatgacgaccggcgcacgggtgcgtaacgcgtatccaaccttccccctaccagggaatagcccgttgaaagacggattaatgccctatgttgtgtgataatggcatcagagttacacgaaagactttgtcggtatgg

SEQ ID NO: 1502 - DNA, 225 bp, Unknown
  Encodes 16S rRNA from Sphingobacterium
agagtttgatcatggctcaggatgaacgctagcggcaggcctaatacatgcaagtcgaacgggatccagatcaaagcttgctttggtttggtgagagtggcgcacgggtgcgtaacgcgtgagcaacctacccttgtcagggggatagcccggcgaaagtcggattaataccgcatgacatcattgagaggcatctttctatgatcaaagatttatcggacaagg

SEQ ID NO: 1503 - DNA, 225 bp, Unknown
  Encodes 16S rRNA from Fusibacter
agagtttgatcctggctcaggattaacgctggcggcgtgcctaacacatgcaagtcgagcgggaaatttgagagtgaagcttcggcggaacttttaaatggagagcggcggacgggtgagtaacgcgtaggtaacctgccctgcacagagggatagccactggaaacggtgattaatacctcataaaactgttttgccgcatgacaaaacagccaaagatttatc

SEQ ID NO: 1504 - DNA, 225 bp, Unknown
  Encodes 16S rRNA from Howardella
agagtttgatcctggctcaggataaacgctggcggcgcacataagacatgcaagtcgaacggaagtcgttattttagaagtggaaagaagatttatctgatagaagcagaagaaataacaatggctttagtggcggactggtgagtaacacgtaagcaacctggctattagaggggaataacagtgagaaatcattgctaataccgcataagcttgtaataccgc

SEQ ID NO: 1505 - DNA, 225 bp, Unknown
  Encodes 16S rRNA from Pedobacter
agagtttgatcatggctcaggatgaacgctagcggcaggcctaatacatgcaagtcgaacggtaaagtccccttcgggggattgagagtggcggacgggtgcgtaacgcgtatgcaaccaacccccctcaccgggatagccggtggaaacgccggataagaccggatgcgcccatggggaggcatctccctgcgggcaaggcggcgacgcggagggggacgggca

SEQ ID NO: 1506 - DNA, 225 bp, Unknown
  Encodes 16S rRNA from Caldilinea
agagtttgatcatggctcaggatgaacgctggcggcgtgcttaacacatgcaagtcgaacgtgagagatagcaatatcttgaaagtggcaaacgggtgagtaacacgtagataacctgcctcggagtgggggataaccacgggaaactgtggctaataccgcatagtcttgcggacacgggagtgtcggcaagtaaagctttagtgcttcgagaggggtctgcgt

SEQ ID NO: 1507 - DNA, 225 bp, Unknown
  Encodes 16S rRNA from Turicibacter
agagtttgatcctggctcaggatgaacgctggcggcgtgcctaatacatgcaagtcgaacggagcacttcggtgcttagtggcgaacgggtgagtaacacataaacaatctaccctgaagactgggataacggttggaaacgaccgctaataccggataggtaactctgaggcatcttagagttattaaagttgggttacaacactgcaggatgagtttatgtcg

SEQ ID NO: 1508 - DNA, 225 bp, Unknown
  Encodes 16S rRNA from Clostridium IV
agagtttgatcctggctcaggacgaacgctggcggcgtgcttaacacatgcaagtcgaacggtcttcttacgggtagcaatacttgtttgaagatagtggcggacgggtgagtaacgcgtgagcaacctgcccatcagaggggaatagcgtctggaaacggacgataataccgcataaaactgagtcaccgcatgatgacacagccaaaggagaaatccgctgat

SEQ ID NO: 1509 - DNA, 225 bp, Unknown
  Encodes 16S rRNA from Alistipes
agagtttgatcatggctcaggatgaacgctagcggcaggcctaacacatgcaagtcgaggggcagcgcggtgtagcaatacactggcggcgaccggcgcacgggtgcgtaacgcgtatgcaacccacccgcgacaggggcataacggggggaaacccccactaattccccgtaaggccgcgtccccgcatggggatgcggcgaaagccttcgggcggttgcggac

SEQ ID NO: 1510 - DNA, 225 bp, Unknown
  Encodes 16S rRNA from Clostridium XlVa
agagtttgatcatggctcaggatgaacgctggcggcgtgcttaatacatgcaagtcgaacggaagatacccagagcttgctcttgatatctttagtggcggacgggtgagtaacgcgtgggtaacctgcctcatacagggggataacagttagaaatgactgctaaaaccgcataacattgcagtgccgcatgatactgcgatcaaatatttataggtatgagat

SEQ ID NO: 1511 - DNA, 225 bp, Unknown
  Encodes 16S rRNA from Clostridium XlVa
agagtttgatcatggctcaggatgaacgctggcggcgtgcttaacacatgcaagtcgaacggagcttattaagaaagcggagcttgctccaatggatttttaagcttagtggcggacgggtgagtaacgcgtgggtaacctgccttgcacagggggacaacagttggaaacgactgctaataccgcataagccggtagcttcgcatgaagcatccggaaaagatt

SEQ ID NO: 1512 - DNA, 225 bp, Unknown
  Encodes 16S rRNA from Prevotella
agagtttgatcatggctcaggatgaacgctagctacaggcttaacacatgcaagtcgaggggaaacggaaggcggagcttgctttgcctagacgtcgaccggcggatgggtgcgtaacgcgtatccaacctgcccgtgtcccggggatagcccatggaaacgtggattaacacccgatggtcctgcgcttccgcatggcggcgcaggtaaacgtgagggacatgg

SEQ ID NO: 1513 - DNA, 225 bp, Unknown
  Encodes 16S rRNA from Clostridium XlVa
agagtttgatcctggctcaggatgaacgctggcggcgtgcctaacacatgcaagtcgaacgagggtcctaaacctgagattcgtcgaaggggagggaattccgagtggcggatgggtgagtaacgcgtggagaacctgccctttgctgggggataacaactggaaacggttgacaataccgcataagctcggttggccgcatgaccgaccgaggaaagatttatc

SEQ ID NO: 1514 - DNA, 225 bp, Unknown
  Encodes 16S rRNA from Butyricimonas
agagtttgatcctggctcaggatgaacgctagcgacaggcttaacacatgcaagtcgaggggcagcatgggggtggcaacacctctgatggcgaccggcgcactggtgagtaacacgtatgcgacctgccccgttccggggtatagaccagggaaacttggcgtaatcccccatgtgccctggggctgcatggccccatggtgaaaggttcgccgggacgggatg

SEQ ID NO: 1515 - DNA, 225 bp, Unknown
  Encodes 16S rRNA from Anaerovibrio
agagtttgatcctggctcaggacgaacgctggcggcgtgcttaacacatgcaagtcgaacggggcgaagaggagcttgctcttcctagcctagtggcaaacgggtgagtaacgcgtaggcaacctgcccttcagatggggacaacatttcgaaaggaatgctaataccgaatgatgtacattggtcgcatgactgatgcaccaaaggccgggcaaccggtcactg

SEQ ID NO: 1516 - DNA, 225 bp, Unknown
  Encodes 16S rRNA from Prevotella
agagtttgatcatggctcaggatgaacgctagctacaggcttaacacatgcaagtcgaggggcagcatgtcgtgtgcttgcacacgatgatggcgaccggcgcacgggtgagtaacgcgtatccaacctgcccatgactccgggatagcccgctgaaaagcggattaacaccggatgcggtcgaaagaggacatctgatttcgaccaaagcttcggcggtcatgg

SEQ ID NO: 1517 - DNA, 225 bp, Unknown
  Encodes 16S rRNA from Pseudoflavonifractor
agagtttgatcatggctcaggatgaacgctggcggcgtgcataacacattcaagtcgaacggactgattcgatagcttgctattgatgaaagttagtggcggacgggtgagtaacgcgtgagcaacctgcccctatgtgcgggataacgtctggaaacggacgctaataccgcataaaccaatcggaccgcatgatctggttggcaaagatttattgcataggga

SEQ ID NO: 1518 - DNA, 225 bp, Unknown
  Encodes 16S rRNA from Corynebacterium
agagtttgatcatggctcaggacgaacgctggcggcgtgcttaacacatgcaagtcgaacggaaaggcccagcttgctgggtgctcgagtggcgaacgggtgagtaacacgtgggtgatctgcccctaacttcgggataagcttgggaaactgggtctaataccggataggacaatcgtttagtgtcggttgtggaaagttttttcggttagggatgagcccgcg

SEQ ID NO: 1519 - DNA, 225 bp, Unknown
  Encodes 16S rRNA from Leucobacter
agagtttgatcatggctcaggacgaacgctggcggcgtgcttaacacatgcaagtcgaacgatgaagcctagcttgctgggtggaagagtggcgaacgggtgagtaacacgtgagtaacctgccccgaactctgggataagcgctggaaacggcgtctaatactggatatgcaccatggaggcatcttctgtggtgggaaagatttatcggttcgggatgggctc

SEQ ID NO: 1520 - DNA, 225 bp, Unknown
  Encodes 16S rRNA from Kerstersia
agagtttgatcctggctcagattgaacgctagcgggatgctttacacatgcaagtcgaacggcagcacgaggagcttgctccttggtggcgagtggcgaacgggtgagtaatatatcggaacatgcccagtagcgggggataactactcgaaagagtggctaataccgcatacgtcctacgggagaaagcaggggaccttcgggccttgcactattggagtggcc

SEQ ID NO: 1521 - DNA, 225 bp, Unknown
  Encodes 16S rRNA from Slackia
agagtttgatcctggctcaggatgaacgccggcggcgcgcctaacacatgcaagtcgagcggaggacctgtcttcggacaggcgatcagcggcgaacgggtgagtaacgcgtgggcaacctgccccccgcacgggaatagccccgggaaaccgggggtaatgcccgacggcccggcagaggggcatccctctgccggcgaagccatcgcggcgggggatgggccc

SEQ ID NO: 1522 - DNA, 225 bp, Unknown
  Encodes 16S rRNA from Lactococcus
agagtttgatcatggctcaggacgaacgctggcggcgtgcctaatacatgcaagttgagcgctgaaggttggtacttgtaccgactggatgagcagcgaacgggtgagtaacgcgtggggaatctgcctttgagcgggggacaacatttggaaacgaatgctaataccgcataaaaactttaaacacaagttttaagtttgaaagatgcaattgcatcactcaaa

SEQ ID NO: 1523 - DNA, 225 bp, Unknown
  Encodes 16S rRNA from Prevotella
agagtttgatcatggctcaggatgaacactagctacaggcttaacacatgcaagtcgaggggtaacatgattggagcttgctccgattgatgacgaccggcgcacgggtgcgtaacgcgtatccaaccttccccctaccagggaatagcccgttgaaagacggattaatgccctatgttgtgtgataatggcatcagagttacacgaaagactttgtcggtatgg

SEQ ID NO: 1524 - DNA, 225 bp, Unknown
  Encodes 16S rRNA from Clostridium IV
agagtttgatcctggctcaggacgaacgctggcggcgcgcctaacacatgcaagtcgaacggagagtgggttttgattctttcgggatgatgaattcatttcttagtggcggacgggtgagtaacacgtgagcaacctgccttgcagagcgggataacggttggaaacgatcgctaataccgcataacatatgattgtcgcatggctatcatatcaaagatttat

SEQ ID NO: 1525 - DNA, 225 bp, Unknown
  Encodes 16S rRNA from Prevotella
agagtttgatcctggctcaggatgaacgctagctacaggcttaacacatgcaagtcgaggggaaacggaagggaaagcttgctttccctagacgtcgaccggcggatgggtgcgtaacgcgtatccaacctgcccgtgtcccggggatagcccatggaaacgtggattaacacccgatggccctgcgcttccgcatggcggcgcaggtaaacgcgagggacatgg

SEQ ID NO: 1526 - DNA, 225 bp, Unknown
  Encodes 16S rRNA from Bacteroides
agagtttgatcctggctcaggatgaacgctagctacaggcctaacacatgcaagtcgcggggcagcattgaggtagcaatacctcagatggcgaccggcgcacgggtgcgtaacgcgtatccaacctggcccttactcgggtatagccctgcgaaagtaggattaatccccgatgttgtcaagatggagccttttttcttgaccaaagatttatcggtaagggat

SEQ ID NO: 1527 - DNA, 225 bp, Unknown
  Encodes 16S rRNA from Lactobacillus
agagtttgatcatggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatgg

SEQ ID NO: 1528 - DNA, 225 bp, Unknown
  Encodes 16S rRNA from Prevotella
agagtttgatcatggctcaggatgaacgctagctacaggcttaacacatgcaagtcgaggggcagcatgattctagcttgctagaattgatggcgaccggcgcacgggtgcgtaacgcgtatccaaccttcccgcgagtcaggcacagcccggcgaaagtcggattaattcctgatgttctcctttgacggcatcagagaaggagtaaagaatttttcgcttgcg

SEQ ID NO: 1529 - DNA, 225 bp, Unknown
  Encodes 16S rRNA from Clostridium XlVa
agagtttgatcctggctcaggatgaacgctggcggcgtgcctaacacatgcaagtcgaacggagtttatgaagttttcggactgagtaaacttagtggcggacgggtgagtaacgcgtgggtaacctgcctcatacagggggataacagttggaaacggctgctaaaaccgcataagcatacattgtcgcatgacagagtgtgaaaatatttataggtatgagat

SEQ ID NO: 1530 - DNA, 225 bp, Unknown
  Encodes 16S rRNA from Clostridium sensu stricto
agagtttgatcctggctcaggacgaacgctggcggcgtgcttaacacatgcaagtcgagcgaggatctcaccggaaggccttcgggccggaaggtaagattcgagcggcggacgggtgagtaacgcgtgagcgatctgtcccgcacagggggataacacttggaaacaggtgctaataccgcataagaccacgaggccgcatggccatggggtaaaaggagcgat

SEQ ID NO: 1531 - DNA, 225 bp, Unknown
  Encodes 16S rRNA from Syntrophococcus
agatttgatcctggctcaggatgaacgctggcggcgtgcctaacacatgcaagtcgagcggagtatgacgagtgcttgcacatgtcatacttagcggcggatgggtgaggaacgcgtggagaacctgcccctcacagggggataacagttggaaacgactgttaataccgcatatgctcacggtgccgcatggcacagggaggaaagatttcatcggtgagagat

SEQ ID NO: 1532 - DNA, 225 bp, Unknown
  Encodes 16S rRNA from Clostridium XlVa
agagtttgatcctggctcaggatgaacgctggcggcgtgcctaacacatgcaagtcgaacggaaattgctgattgaagctttcgggtggatttcagtaattttagtggcggacgggtgagtaacacgtgggtaacctgccctgtaccgggggataacagttggaaacggctgttaataccgcataagcgcacagcttcgcatgaagcagtgtgaaaaactccggt

SEQ ID NO: 1533 - DNA, 225 bp, Unknown
  Encodes 16S rRNA from Victivallis
agagtttgatcatggctcagaatgaacgctggcggcatggattaggcatgcaagtcgaacgagaaagcggcttcggccgcgagtaaagtggcgaaagggtgagtagcacgtggggaacctgccccggggaccggaacaagcctgtgaaaacgggtctgagaccggatgtcgccccggcccgcatgggccggaggcgaaagattaatcgccccgggatggccccgc

SEQ ID NO: 1534 - DNA, 225 bp, Unknown
  Encodes 16S rRNA from Bacteroides
agagtttgatcctggctcaggatgaacgctagctacaggcctaacacatgcaagtcgcggggcagcatgggcgtagcaatacgcctgatggcgaccggcgcacgggtgcgtaacgcgtatccaacctggcccttactcgggtatagccctgcgaaagtaggattaatccccgatgttgtcaagcgatagccttttcacttgaccaaagagtttttcggtaaggga

SEQ ID NO: 1535 - DNA, 225 bp, Unknown
  Encodes 16S rRNA from unknown taxa
agagtttgatcctggctcaggatcaacgctggcggcgtgcctaatgcatgcaagtcgagcggggtgtccttcggggcgcttacgcggcggacgggtgcggaacacgtgggcaacctgccctgaggtgggggatagccggtggaaacaccgggtaattccgcatacggtcacggaccggggggtctgtgaggaaaggctcgtaagagtcgccttgggaggggcctg

SEQ ID NO: 1536 - DNA, 225 bp, Unknown
  Encodes 16S rRNA from Clostridium XlVa
agagtttgatcctggctcaggatgaacgctggcggcgtgcctaacacatgcaagtcgaacgaagcatgctggaaagagaccttcggggaaccggaaatcatgacttagtggcggacgggtgagtaacgcgtgggcaacctgccgtacacagggggacaacagctggaaacggctgctaataccgcataagcgcacagcttcgcatggagcggtgtgaaaagcatt

SEQ ID NO: 1537 - DNA, 225 bp, Unknown
  Encodes 16S rRNA from Prevotella
agagtttgatcatggctcaggatgaacgctagctacaggcttaacacatgcaagtcgaggggcagcatggcggtagcaataccgccgatggcgaccggcgcacgggtgagtaacgcgtatccaaccttccccctggtagggcatagcccggcgaaagtcggattaataccctatgttttcctttgacggcatccgacgaggaacaaagatttatcgcccggggat

SEQ ID NO: 1538 - DNA, 225 bp, Unknown
  Encodes 16S rRNA from unknown taxa
agagtttgatcctggctcagaacgaacgctggtagcgtggattaggcatgcaagtcgaacgggatcagccggttagcaataattggctgtgagagtggcggattggggaggaacacgtgagcaacctgcccttgagttggggaaaaccgttggaaacgacggctaataccggatgtggcgcccggagacatcttcggagcgctaaagggggccgcaaggctcccg

SEQ ID NO: 1539 - DNA, 225 bp, Unknown
  Encodes 16S rRNA from Clostridium XlVa
agagtttgatcatggctcaggatgaacgctggcggcgtgcctaacacatgcaagtcgaacgaagaccccgaagcggaaatttcggttgaagtggagggaggactgagtggcggacgggtgagtaacgcgtggataacctgccccatacagggggatagcagttggaaacgactgataataccgcatgagcgcacgtggagacatctccatgtgtgaaaagaaata

SEQ ID NO: 1540 - DNA, 225 bp, Unknown
  Encodes 16S rRNA from Treponema
agagtttgatcatggctcagaacgaacgctggcggcgcgtcttaagcatgcaagtcgagcgggaatagaggtgcttgcacttctatgagagcggcggactggtgagtaacacgtaggcaacgtacccttcggacggggatagccggcagaaatgtcgggtaataccggatgtgaacttacttcgtgaaggagtaagtggaaaggagcttcggctccgccggagga

SEQ ID NO: 1541 - DNA, 225 bp, Unknown
  Encodes 16S rRNA from Pyramidobacter
agagtttgatcctggctcaggatgaacgctggcggcgtgcttaacacatgcaagttgcgcggggatctgacgatgagacttcggtggatttgttagatcctagcggcggacgggtgagtaaagcacaaggacgtgtccgagcgaggggggcaactgcgggaaaccgtagctaataccccgtaagccgagaggtgaaagcagcaatgcgcgagcggagcgacttgt

SEQ ID NO: 1542 - DNA, 225 bp, Unknown
  Encodes 16S rRNA from Robinsoniella
agagtttgatcctggctcaggatgaacgctggcggcgtgcctaacacatgcaagtcgaacggggtgtcaatcttcggaaagacacttagtggcggacgggtgagtaacgcgtgggtaacctgcctcatacagggggatagcagttggaaacgactgataataccgcataagcgcacagcatcgcatgatgcagtgtgaaaaactccggtggtatgagatggaccc

SEQ ID NO: 1543 - DNA, 225 bp, Unknown
  Encodes 16S rRNA from Lachnospiracea incertae sedis
agagtttgatcatggctcaggatgaacgctggcggcgtgcttaacacatgcaagtcgagcgaagcactctggaagattccttcgggatgattccttagtgacttagcggcggacgggtgagtaacgcgtgggcaacctgccttgtacagggggataacagttagaaatgactgctaataccgcataagcacacagcatggcatcatgcagtgtgaaaaactccgg

SEQ ID NO: 1544 - DNA, 225 bp, Unknown
  Encodes 16S rRNA from Clostridium XI
agagtttgatcctggctcaggacgaacgctggcggcgtgcctaacacatgcaagtcgagcgaggatttagcggaaggaagcttcggcagagagaaggtaaatcttagcggcggacgggtgagtaacgcgtgaacaatctgtcccggacagggggataacacatggaaacaggtgctaataccgcataagaccacagcgtcgcatggcggtggggtaaaaggagaa

SEQ ID NO: 1545 - DNA, 225 bp, Unknown
  Encodes 16S rRNA from Bifidobacterium
agagtttgatcatggctcaggatgaacgctggcggcgtgcttaacacatgcaagtcgaacgggatccctggcagcttgctgccggggtgagagtggcgaacgggtgagtaatgcgtgaccgacctgccccatgcaccggaatagctcctggaaacgggtggtaatgccggatgttccacatgagcgcatgcgagtgtgggaaaggctttttgcggcatgggatgg

SEQ ID NO: 1546 - DNA, 225 bp, Unknown
  Encodes 16S rRNA from Bacteroides
agagtttgatcctggctcaggatgaacgctagctacaggcttaacacatgcaagtcgaggggcagcggggagtggcaacactctgccggcgaccggcgcacgggtgagtaacacgtatccaacctgccctgagcttggggatagccctctgaaaggaggattaatacccgatgtggttgtttggcgacatcgcctttcaattaaagatttatcggctcatgatgg

SEQ ID NO: 1547 - DNA, 225 bp, Unknown
  Encodes 16S rRNA from Gordonibacter
agagtttgatcatggctcaggatgaacgctggcggcgtgcttaacacatgcaagtcgaacgattaaaccggctccggccggaaatagagtggcgaacgggtgagtaacacgtgaccaacctgccccgcgcaccgggacagcctcgcgaaagcgggattaataccggatactccggcggcgcgggatggggtcgcggcccatcaggtagtgggtcgggtagaggcc

SEQ ID NO: 1548 - DNA, 225 bp, Unknown
  Encodes 16S rRNA from Enterorhabdus
agagtttgatcatggctcaggatgaacgctggcggcgtgcctaacacatgcaagtcgaacggttaagccggcttcggccgggaataaagtggcgaacgggtgagtaacacgtgaccaacctgccccgcgcaccgggacagccccccgaaagggggattaataccggatactccgcggcccccgcatgggggccgcgggaaagctccggcggcgcgggatggggtc

SEQ ID NO: 1549 - DNA, 225 bp, Unknown
  Encodes 16S rRNA from Lactobacillus
agagtttgatcctggctcaggacgaacgctggcggcgtgcctaatacatgcaagtcgaacgagtttgcttttaatgaaggcggtgcttgcaccaactgatttaaaaataaacgagtggcggacgggtgagtaacacgtgggtaacctaccctaaagtgggggataacatttggaaacagatgctaataccgcataatattaaaaaccacatggtttttaattgaa

SEQ ID NO: 1550 - DNA, 225 bp, Unknown
  Encodes 16S rRNA from Bacteroides
agagtttgatcatggctcaggatgaacgctagctacaggcttaacacatgcaagtcgaggggcagcataggggaggtttcggccacccccgatggcgaccggcggatgggtgagtaacgcgtatccaacctgcccctgtcccggggacagcccttagaaatgaggattaacccccgatggcgcggagaggccgcatggcttttccgccaaatgcgaaggacaggg

SEQ ID NO: 1551 - DNA, 225 bp, Unknown
  Encodes 16S rRNA from Prevotella
agagtttgatcatggctcaggatgaacgctagctacaggcttaacacatgcaagtcgaggggcatcaggacggtagcttgctatcgttgctggcgaccggcgcacgggtgcgtaacacgtatcgaacctacctgccgctcggggatagccctctgaaaggaggattaatacccgatggtttccaatggggacatccccgttggaataaagattcattggcggcgg

SEQ ID NO: 1552 - DNA, 225 bp, Unknown
  Encodes 16S rRNA from Tannerella
agagtttgatcatggctcaggatgaacgctagcgacaggcctaacacatgcaagtcgagggagaagttagaagtagcttgctacggaagatggaaaccggcgcacgggtgcgtaacaggtgtgcaatctgtccatagtcggggaatagcccagcgaaagttggattaaagctccatgtgagtgagaatcgcatgtttttcacttgaaacgtaaggactatgggtg

SEQ ID NO: 1553 - DNA, 225 bp, Unknown
  Encodes 16S rRNA from Bacteroides
agagtttgatcctggctcaggatgaacgctagctacaggcttaacacatgcaagtcgaggggcatcaggggactagcttgctagtcctgctggcgaccggcgcacgggtgagtaacacgtatccaacctgcccccagcttggggatagccctctgaaaggaggattaatacccgatatgcttgttctccggcatcggaggacaatcaaagattcatcggctgtgg

SEQ ID NO: 1554 - DNA, 225 bp, Unknown
  Encodes 16S rRNA from Prevotella
agagtttgatcatggctcaggatgaacgctagcggcaggcttaacacatgcaagtcgaggggcagcgcggagtagcaatactttggcggcgaccggcggaagggtgcgtaacgcgtgagcaacctgcccgtgtccggggcataatcggtggaaacgccgtctaattccccatacgttgctgggcgacatcgcttagtaatgaaaacttattgcggacacggatgg

SEQ ID NO: 1555 - DNA, 225 bp, Unknown
  Encodes 16S rRNA from Clostridium XlVb
agagtttgatcatggctcaggatgaacgctggcggcgtgcctaacacatgcaagtcgaacgagagaggcgaagagcttgctttttgccaatcgagtggcggacgggtgagtaacgcgtgagcaacctgccttacattggggaataacgtttggaaacggacggtaataccgcatatgcagacaagtacggcatcgtacggtttggaaagatttatcgatgtaaga

SEQ ID NO: 1556 - DNA, 225 bp, Unknown
  Encodes 16S rRNA from Gelidibacter
agagtttgatcatggctcaggataaacgctagcggcaggcctaacacatgcaagtcgagcggcagcgggagtggcaacacttgccggcgagcggcggacgggtgagtaacgcgtatgcaacctgcccaccacacggagatagccgaccgaaaggacgattaaactccgatggcattgggactcggcatcgggatccaattaaatatttataggtggtggatgggc

SEQ ID NO: 1557 - DNA, 225 bp, Unknown
  Encodes 16S rRNA from unknown taxa
agagtttgatcatggctcaggatgaacgctggcggcgtgcttcatacatgcaagtcgaacgtgaagctgacttcggtcagtggaaagtggcggacgggtgagtaatacataggaaatctgcccttagctgggggacaacagttggaaacgactgctaataccgcatatgagcttagctgaaatgctaatcttgaaaactacggtggctaaggatgagcctgtgcc

SEQ ID NO: 1558 - DNA, 225 bp, Unknown
  Encodes 16S rRNA from Rhodoplanes
agagtttgatcatggctcagaacgaacgctggcggcaggcttaacacatgcaagtcgaacgccccgcaaggggagtggcagacgggtgagtaacacgtgggaacgtgccttttggttcggaacaacttcgggaaactggagctaataccggataagcccttcgggggaaagatttatcgccaaaagatcggcccgcgtctgattagctagttggtggggtaatgg

SEQ ID NO: 1559 - DNA, 225 bp, Unknown
  Encodes 16S rRNA from Selenomonas
agagtttgatcatggctcaggacgaacgctggcggcgtgcttaacacatgcaagtcgaacgagacggatagaagcttgcttttagaagtcgagtggcaaacgggtgagtaacgcgtagacaacctgcctctgggatggggacaacagcccgaaagggctgctaataccgaatgaaatggtttcttctcctgaagttatcatgaaagatggcctctatttataagc

SEQ ID NO: 1560 - DNA, 225 bp, Unknown
  Encodes 16S rRNA from Escherichia/Shigella
agagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataatgtcgcaagaccaaagagggggaccttcgggcctcttgccatcggatgtg

SEQ ID NO: 1561 - DNA, 225 bp, Unknown
  Encodes 16S rRNA from Rikenella
agagtttgatcctggctcaggatgaacgctagcggcaggcttaacacatgcaagtcgaggggcagcaggccgggtagcaatacttggtgctggcgaccggcgcacgggtgcgtaacgcgtatgcaacctgcccgtaacaggggtataacggagggaaacttccactaatcccccatattgtcactttttcgcatggggaggtgacgaaagcttaattgtggttac

SEQ ID NO: 1562 - DNA, 225 bp, Unknown
  Encodes 16S rRNA from Coprococcus
agagtttgatcatggctcaggatgaacgctggcggcgtgcttaacacatgcaagtcgaacggaacattccacccgaagattgaagaagcttgcttcggattgattcaaccggaatgtttagtggcggacgggtgagtaacgcgtgggtaacctaccttacacagggggataacagttagaaatgactgctaataccgcataagcgcacggtaccgcatggtacag

SEQ ID NO: 1563 - DNA, 225 bp, Unknown
  Encodes 16S rRNA from Clostridium sensu stricto
agagtttgatcctggctcaggacgaacgctggcggcgcgcctaacacatgcaagtcgaacgggactagtgaccggagcttagaatttctctaggttgcgttcactagttcagtggcggacgggtgagtaaagcatgagtaactttcccattagtggggaatagcttttggaaacagaagataataccgcatacatcgttgaggactcatgttctcttcggaaaag

SEQ ID NO: 1564 - DNA, 225 bp, Unknown
  Encodes 16S rRNA from Hyphomicrobium
agagtttgatcctggctcagaacgaacgctggcggcaggcctaacacatgcaagtcgaacgctgtagcaatacagagtggcagacgggtgagtaacacgtgggaatcttcctatcggtacggaatagctcagggaaacttggggtaataccgcatacgcccttcgggggaaagatttatcgccgatagatgagcccgcgtctgattagctagttggtgaggtaat

SEQ ID NO: 1565 - DNA, 225 bp, Unknown
  Encodes 16S rRNA from Erysipelotrichaceae incertae sedis
agagtttgatcatggctcaggatgaacgctggcggcatgcctaatacatgcaagtcgaacgaagcgacctcaacagaattgtgcttgcacaaggaagatgagattctcgcttagtggcgaacgggtgagtaacacgtaggtaacctgcccatctacctgggacaacagttagaaatgactgctaaaaccggataggtaacattgaggcatctcgatgttattaaa

SEQ ID NO: 1566 - DNA, 225 bp, Unknown
  Encodes 16S rRNA from unknown taxa
agagtttgatcctggctcagaacgaacgctggtagcgtggattaggcatgcaagtcgaacgggatcaccgatatagtaatattgaggtgtgagagtggcggattggggaggaacacgtgagcaacctgccttggagtcggggaaaaccgttggaaacgacggctaataccggatgtggcgcccggtgacatcaccggagcgctaaagggggccgcaaggctctcg

SEQ ID NO: 1567 - DNA, 225 bp, Unknown
  Encodes 16S rRNA from Staphylococcus
agagtttgatcctggctcaggatgaacgctggcggtatgcctaatacatgcaagtcgagcgagagacttcggtctctagcggcgaacgggtgagtaacaagttggtaatctgcctattagttggggatacccaggcgaaagcttggctaataccgtaatacgtaataagctgaaatgcttattataaaaggcgcttcggcgtcgctaatagatgagcctgcttct

SEQ ID NO: 1568 - DNA, 225 bp, Unknown
  Encodes 16S rRNA from unknown taxa
agagtttgatcatggctcagaacgaacgctggtagcgtggattaggcatgcaagtcgaacgggatccatgaagtagcaatacggattggtgagagtggcggaagggcgaggaacacgtgggcaacctgtccaggaggtggggaaaacctcgggaaactgaggctaataccgaatgtggcgcccgcacgcatgtgcggagcgccaaagggggcgaaagctccccct

SEQ ID NO: 1569 - DNA, 225 bp, Unknown
  Encodes 16S rRNA from Victivallis
agagtttgatcctggctcagaacgaacgctggcggcatggattaggcatgcaagtcgaacgaagtagcaatacttagtggcgcaagggtgaggaacacgtgagtgacctgcccgcaagtttggaacagctcctggaaacgggaattaataccggatgtgatcatattgctgcatggtgatatgattaaagcagtaatgcgcttgcggatgggctcgcgtcccatt

SEQ ID NO: 1570 - DNA, 225 bp, Unknown
  Encodes 16S rRNA from Selenomonas
agagtttgatcctggctcaggacgaacgctggcggcgtgcttaacacatgcaagtcgaacgagggaattcttttcggagaatataccgagtggcaaacgggtgagtaacgcgtaggcaacctgccttcaagatggggacaacagtccgaaagggctgctaataccgaatgacatgtctgaaccgcatgggacggacagcaaagacggcctccaaactatgctgtc

SEQ ID NO: 1571 - DNA, 225 bp, Unknown
  Encodes 16S rRNA from Desulfobulbus
agagtttgatcctggctcagaacgaacgctggcggcgtgcttaacacatgcaagtcgaacgcgaaagcggcttcggccgtgagtagagtggcgcacgggtgagtaacgcgtagataacctgtcttcatatccgggataacacgccgaaaggggtactaataccggatatactcgcatttcaataggtgaggcgaggaaaggtggcctctgattcaagctactgta

SEQ ID NO: 1572 - DNA, 225 bp, Unknown
  Encodes 16S rRNA from Clostridium III
agagtttgatcctggctcaggacgaacgctggcggcgtgcctaacacatgcaagtcgagcggagccaattgacggatcccttcggggtgaagacgaggaagcttagcggcggacgggtgagtaacgcgtgagtaacctgcctgtaagagggggataattcctggaaacggggactaataccgcatattgagcacatatcgcatggtatatgcttgaaagatttat

SEQ ID NO: 1573 - DNA, 225 bp, Unknown
  Encodes 16S rRNA from Spirochaeta
agagtttgatcatggctcagaacgaacgctggcggtgcgttttaagcatgcaagttgagcggcagtagtagcaatactatgagagcggcggacgggtgagtaacacgtggataatctaccttgaagtttggaatataccgtggaaacacggagtaataccggataagacggtacttggggacaagtattgggaaaggtgctacggcatcgctttaagatgagtcc

SEQ ID NO: 1574 - DNA, 225 bp, Unknown
  Encodes 16S rRNA from Kordia
agagtttgatcctggctcaggataaacgctagcggcaggcctaacacatgcaagtcgagcggtaacacggtgtagcaatacattggtgacgagcggcggacgggtgagtaacgcgtatgcaacctacccactacacaaggatagccttccgaaaggaggattaatacttgatagtactctaagatggcatcaaaacagagttaaagatttatcggtagtggatgg

SEQ ID NO: 1575 - DNA, 225 bp, Unknown
  Encodes 16S rRNA from Bosea
agagtttgatcctggctcagagcgaacgctggcggcaggcttaacacatgcaagtcgaacgcatccttcgggatgagtggcagacgggtgagtaacacgtgggaacgtacctctttgttcggaataactcatggaaacgtgagctaataccggatacgcccttttggggaaagatttatcgcagagagatcggcccgcgtctgattagctagttggtgaggtaat

SEQ ID NO: 1576 - DNA, 225 bp, Unknown
  Encodes 16S rRNA from Enterococcus
agagtttgatcctggctcaggacgaacgctggcggcgtgcctaatacatgcaagttgaacgcttctttctgatcgaacttcggttcaccaagaaagaagagtagcgaacgggtgagtaacacgtgggtaacctgcccatcagcgggggataacacttggaaacaggtgctaataccgcataatactttttctctcatgagtgaaagttgaaaggcgcttttgcgt

SEQ ID NO: 1577 - DNA, 225 bp, Unknown
  Encodes 16S rRNA from Clostridium III
agagtttgatcatggctcaggacgaacgctggcggcgtgcctaacacatgcaagtcgaacggagctatttagacagaacccttcggggggaagattacttagcttagtggcggacgggtgagtaacgcgtgagtaacctgcccataagagggggataacacagagaaatttgtgctaataccgcatatagatataatatcgcatggtaatgtattgaaagattta

SEQ ID NO: 1578 - DNA, 225 bp, Unknown
  Encodes 16S rRNA from Xanthobacter
agagtttgatcatggctcagagcgaacgctggcggcaggcctaacacatgcaagtcgagcgcccagcaatgggagcggcagacgggtgagtaacgcgtggggatctacccattggtacggaataacccagggaaacttggactaataccgtatgtgtccttcgggagaaagatttatcgccaatggatgaacccgcgtctgattagctagttggtgaggtaaagg

SEQ ID NO: 1579 - DNA, 225 bp, Unknown
  Encodes 16S rRNA from Lactobacillus
agagtttgatcatggctcaggacgaacgctggcggcatgcctaatacatgcaagtcgaacgagttcccgttgattgacgtgcttgcactgatttcaacattggaacgagtggcgaactggtgagtaacacgtggaaaacctgcccagaagcaggggataacacttggaaacaggtgctaataccgtataacaacaaaaaccgcatggtttttgtttgaaaggtgg

SEQ ID NO: 1580 - DNA, 225 bp, Unknown
  Encodes 16S rRNA from Prevotella
gctttgatcatggctccggatgcacgctcgctccaggcttaacacatgccagtcgaggggtaacggcagtgaagcttgctttactggccgacgaccggcgcacgggtgagtaacgcgtatccaacctgcccatgactcagggataacctttcgaaagggagcctaatacctgatgttgtgagacgagggcatctgagtgtcaccaaagattcatcggtcatggat

SEQ ID NO: 1581 - DNA, 225 bp, Unknown
  Encodes 16S rRNA from Acidaminococcus
agagtttgatcatggctcaggacgaacgctggcggcgtgcttaacacatgcaagtcgaacgggaaacttatttcggtaagtttctagtggcgaacgggtgagtaacgcgtgggtaacctgccctccagatggggacaacattccgaaagggatgctaataccgaatacgatccctccaccgcatggaggagggatgaaagatggcctctgcttgcaagctatcgc

SEQ ID NO: 1582 - DNA, 225 bp, Unknown
  Encodes 16S rRNA from Eubacterium
aggtttgatcctggctcaggatgaacgctggcggcgtgcctaacacatgcaagtcgagcgagaaacctatgtgatgaaacttcggtagaatcttttaggtggaaagcggcggacgggtgagtaacgcgtaggcaacctgcccctagcagggggatagccattggaaacgatgattaaaaccccataatgcagatttatcacatgttggatctgccaaagatttat

SEQ ID NO: 1583 - DNA, 225 bp, Unknown
  Encodes 16S rRNA from Bacteroides
agagtttgatcctggctcaggatgaacgctagctacaggcttaacacatgcaagtcgaggggcagcatgatcgaagcttgctttgatcgatggcgaccggcgcacgggtgcgtaacacgtatccaatctacccaccgctcagggatagccttgcgaaagtaagattaatacctgatggtttccttatgtggcatcatgtatggaataaagattcatcggcgatgg

SEQ ID NO: 1584 - DNA, 225 bp, Unknown
  Encodes 16S rRNA from Clostridium XlVa
agagtttgatcctggctcaggataaacgctggcggcgcacataagacatgcaagtcgaacgaacgacttcaaattgttttactttttgaagaagttagtggcggactggtgaggaacacgtaaacaatctgcctataagaggggaacaacattgagaaatcagtgctaataccgcataagcctacgctatcgcatgataaagtaggaaaaggagtaatccgctta

SEQ ID NO: 1585 - DNA, 225 bp, Unknown
  Encodes 16S rRNA from Lactobacillus
agagtttgatcctggctcaggacgaacgctggcggcatgcctaatacatgcaagtcgaacgagcttccgttgaatgacgtgcttgcactgattttaacaatgaagcgagtggcgaactggtgagtaacacgtgggaaatctgcccagaagcaggggataacacttggaaacaggtgctaataccgtataacaacaaaatccgcatggattttgtttgaaaggtgg

SEQ ID NO: 1586 - DNA, 225 bp, Unknown
  Encodes 16S rRNA from Devosia
agagtttgatcctggctcagaacgaacgctggcggcaggcttaacacatgcaagtcgaacggtctcttcggaggcagtggcagacgggtgagtaacgcgtgggaatctacctagttctacggaacaacagttggaaacgactgctaataccgtatacgccctatgggggaaagatttatcggaattagatgagcccgcgtaagattagctagttggtgaggtaat

SEQ ID NO: 1587 - DNA, 225 bp, Unknown
  Encodes 16S rRNA from Pedobacter
agagtttgatcatggctcaggatgaacgctagcggcaggcttaacacatgcaagtcgaggggcagcgcgggggtagcaatacacctggcggcgaccggcggaagggtgcgtaacgcgtgagcaacatgcccgtcacagggggataaaagatggaaacgtctcctaataccccgtaacatcatttgtggcatcgcagatggttgaaagctattatgcggtgacgga

SEQ ID NO: 1588 - DNA, 225 bp, Unknown
  Encodes 16S rRNA from Clostridium IV
agagtttgatcctggctcaggacgaacgctggcggcgtgcttaacacatgcaagtcgaacgggactgcccgaatgaagttttcggatggaatttgggtatgtttagtggcgaacgggtgagtaacgcgtgagtaacctgccttggagagggggacaacagccggaaacggctgctaataccgcatgacgtcacgggagggcatccttctgtgaccaaagatttat

SEQ ID NO: 1589 - DNA, 225 bp, Unknown
  Encodes 16S rRNA from Clostridium XlVa
agagtttgatcatggctcaggatgaacgctggcggcgtgcctaacacatgcaagtcgaacgaagcacttctcccgttgaagttgattagcttgctatgaagcggaaacatttgaagtgacttagtggcggacgggtgagtaacgcgtgggtaacctgccctgtactgggggacaacagttggaaacggctgctaataccgcataagcgcacagcatcgcatggtg

SEQ ID NO: 1590 - DNA, 225 bp, Unknown
  Encodes 16S rRNA from Corynebacterium
agagtttgatcatggctcaggatgaacgctggcggcgtgcttaacacatgcaagtcgaacggaaaggccttgtgcttgcacaaggtactcgagtggcgaacgggtgagtaacacgtgggtgatctgccctgcactgtgggataagcctgggaaactgggtctaataccatataggaccgcactttggatggtgtggtggaaagcttttgcggtgtgggatgagcc

SEQ ID NO: 1591 - DNA, 225 bp, Unknown
  Encodes 16S rRNA from Spirochaeta
agagtttgatcctggctcagaacgaacgctggcggcgcgtcttaagcatgcaagtcgagcgggattatggtgcttgcaccatatgagagcggcggactggtgagtaacgcgtaggtgacgaaccccccggacggggacagcctctagaaatagagggtaataccggatgaggcgtgcagtgttagaggctgcacgtgaaagcagctccggctgcgccgggggatc

SEQ ID NO: 1592 - DNA, 225 bp, Unknown
  Encodes 16S rRNA from Anaeroplasma
agagtttgatcatggctcaggatgaacgctggcggcgtgcctaatacatgcaagtcgaacgaggtttctcttcggggaaaccgagtggcgaacgggtgagtaacacataggtaatctacctttcagaatgggatacccaagagaaattttggctaataccgtatacaatcatttctccgcatggagatttgatgaaaggggctccaaagcctcgctgttagatga

SEQ ID NO: 1593 - DNA, 225 bp, Unknown
  Encodes 16S rRNA from Clostridium XlVa
agagtttgatcatggctcaggatgaacgctggcggcgtgcttaacacatgcaagtcgaacgaggaatttcagatgaagttttcggatggattctggctttccgagtggcggacgggtgagtaacgcgtgggtaacctgccttacacagggggacaacagccggaaacggctgctaataccgcataacctgctagagtcgcatgactcagacagaaaagatttatc

SEQ ID NO: 1594 - DNA, 183 bp, Unknown
  Encodes 16S rRNA from Lachnospiracea incertae sedis
agagtttgatcatggctcaggataaacgctggcggcgtgctttggacaatgggggcaaccctgatccagcgacgccgcgtgaacgaagaagtatctcggtatgtaaagttctatcagcagggaagataatgacggtacctgactaagaagcaccggctaaatacgtgccagcagccgcgtaat

SEQ ID NO: 1595 - DNA, 225 bp, Unknown
  Encodes 16S rRNA from Saccharofermentans
agagtttgatcatggctcaggacgaacgctggcggcgtgcctaacacatgcaagtcgagcgaggacaatggtttcggctgttgttcgagcggcggacgggtgagtaacgcgtgaacaatctgtccctgacagggggataacacttggaaacaggtgctaataccgcataagaccacgggatcgcatggtactggggtcaaaggagcaatccggtgaggggtgagt

SEQ ID NO: 1596 - DNA, 225 bp, Unknown
  Encodes 16S rRNA from Slackia
agagtttgatcatggctcaggatgaacgccggcggcgcgcctaacacatgcaagtcgagcggcggaccggctccggccggcgagcagcggcgaacgggtgagtaacgcgtgggcaacctgccccccccctcgggaatagcggccggaaacggccggtaatgcccgacggcccccgggagaggcatctcccccggggcaaagccctggcggggggggatgggcccg

SEQ ID NO: 1597 - DNA, 225 bp, Unknown
  Encodes 16S rRNA from Limibacter
agagtttgatcatggctcaggatgaacgctggcggcaggcctaatacatgcaagtcgcacgggatcgctccttcgggggcgtgagagtggcggacgggtgcgcaacgcgtatgcaaccagccccctgcaggcggatagccggtggaaacgccggataatacgccatgtttcgggtagagggcatcctttacctgagaaagcggagacgcggcgggggacgggcat

SEQ ID NO: 1598 - DNA, 225 bp, Unknown
  Encodes 16S rRNA from Sphingobium
agagtttgatcatggctcagagcgaacgctagcggcatgctttatacatgcaagtcgaacgaacgagtttatattgagtagcaatacgatttataaatgagttagtggcgaacgggtgagtaatatataggaatttgcccagtagtgggggacaacagttagaaatgactgctaataccgcatacgtccgagaggagaaagatttatcgctattggagaagccta

SEQ ID NO: 1599 - DNA, 225 bp, Unknown
  Encodes 16S rRNA from Clostridium XlVa
agagtttgatcatggctcaggatgaacgctggcggcgtgcttaacacatgcaagtcgaacgaagcatctttatatgatccctttggggtgatgaattgatgactgagtggcggacgggtgagtaacgcgtgggaaacctgccctgtaccgggggatagcagttggaaacggctgataataccgcataagcgcacagtaagacatcttaccgtgtgaaaaactccg

SEQ ID NO: 1600 - DNA, 225 bp, Unknown
  Encodes 16S rRNA from Riemerella
agagtttgatcatggctcaggatgaacgctagcgggaggcctaacacatgcaagccgagcgggatttagtagttagcttgctaactactgatgagagcggcgtacgggtgcggaacacgtgtgcaacctgcctttatctgggagatagcctttcgaaaggaagattaatatcccataatatattgattggcatcgattaatattgaaagctccggcggataaaga

SEQ ID NO: 1601 - DNA, 225 bp, Unknown
  Encodes 16S rRNA from Saccharofermentans
agagtttgatcatggctcaggacgaacgctggcggcgtgcctaacacatgcaagtcgagcggactttcatcaggaaggtgcttgcaccggaaagatggaagttagcggcggacgggtgagtaacgcgtgagcaatctgtcccatacagggggataataccgcgaaagaggttctaataccgcatgagaccacagtgaggcatctcacaggggtcaaaggagcaat

SEQ ID NO: 1602 - DNA, 225 bp, Unknown
  Encodes 16S rRNA from Bacteroides
agagtttgatcctggctcaggatgaacgctagctacaggcttaacacatgcaagtcgaggggcagcaggagattagcttgctaatcttgctggcgaccggcgcacgggtgagtaacgcgtatccaacctgccccgtactcggggacagccctctgaaaggaggattaatacccgatattgtcgctgtgggacatcccatggtgacgaaagattcatcggtacggc

SEQ ID NO: 1603 - DNA, 225 bp, Unknown
  Encodes 16S rRNA from Prevotella
agagtttgatcatggctcaggatgaacgctagctacaggcttaacacatgcaagtcgaggggcagcacggggtatggcttgccataccctggtggcgaccggcgcacgggtgagtaacgcgtatccaacctgcccgcaaccgcggaatagcccgccgaaaggcggattaatgccgcatgagctcgcgtgggggcatctgcccgcgagcaaaggtccattccggtt

SEQ ID NO: 1604 - DNA, 225 bp, Unknown
  Encodes 16S rRNA from Selenomonas
agagtttgatcctggctcaggacgaacgctggcggcgtgcttaacacatgcaagtcgaacggggcgattgaaagcttgcttttatgagcctagtggcaaacgggtgagtaacgcgtgggcaacctaccggaaagatggggacaacatcccgaaaggggtgctaataccgaatgttgtatatgaggcgcatgcttcatatattaaaggattctatccgctttccga

SEQ ID NO: 1605 - DNA, 225 bp, Unknown
  Encodes 16S rRNA from Victivallis
agagtttgatcctggctcagaacgaacgctggcggcatggattaggcatgcaagtcgaacgaagcagcaatgcttagtggcgcaagggtgaggaacgcgtgagtgacctacccgcaagtttggaacagctcctggaaacgggaattaataccggatgtgatcatagggctgcatggttttatgattaaagcagcaatgcgcttgcggatgggctcgcgtcccatt

SEQ ID NO: 1606 - DNA, 225 bp, Unknown
  Encodes 16S rRNA from Howardella
agagtttgatcatggctcaggataaacgctggcggcgcacataagacatgcaagtcgaacggacttaacttctagcttgctagaagagcggttagtggcggactggtgagtaacacgtaagaaatctgcctatcagaggggaataacagtgagaaatcactgctaataccgcatatgccatagttatcgcatgatgacagtgggaaagaagcaattcgctgatag

SEQ ID NO: 1607 - DNA, 225 bp, Unknown
  Encodes 16S rRNA from Pelospora
agagtttgatcatggctcaggatgaacgctggcggcgcgcctaacacatgcaagtcgaacgaaatgagtagcttcggttacgagtttagtggcggacgggtgagtaacgcgtggataatttgcctttcagtgggggatagctgagagaaatctcaattaataccgcataacataatttgttcgcatgagtgagttattaaagatgcaaatcgctggaagagaagt

SEQ ID NO: 1608 - DNA, 225 bp, Unknown
  Encodes 16S rRNA from Clostridium sensu stricto
agagtttgatcatggctcaggacgaacgctggcggcgcgcctaacacatgcaagtcgaacgggactagtgaccggagcttagaggctttctaggttgcgatcactagttcagtggcggacgggtgagtaaagcatgagtaactttcccataagtggggaatagcttttggaaacagaagataataccgcatgaatcgttgaggacacatgttcacaacggaaaag

SEQ ID NO: 1609 - DNA, 225 bp, Unknown
  Encodes 16S rRNA from Selenomonas
agagtttgatcatggctcagattgaacgctggcggcgtgcttaacacatgcaagtcgaacgagacggatagaagcttgcttttagaagtcgagtggcaaacgggtgagtaacgcgtagacaacctgcctctgggatggggacaacagcccgaaagggctgctaataccgaatgaaatggtttcttctcctgaagagatcatgaaagatggcctctaaattatgct

SEQ ID NO: 1610 - DNA, 225 bp, Unknown
  Encodes 16S rRNA from Fibrobacter
agagtttgatcctggctcaggatgaacgctagcgacaggcctaacacatgcaagtcgagcgaggacgtagcaatacgagccgagcggcgaatgggtgagtaacgcgtaagcaatctgccccgcattccggaacaaccgtgccaacgcgcggctaatgccgggagccgtggcggtccacatgggccgttgacgaaagatttatcgatgcgggatgagcttgcgtcc

SEQ ID NO: 1611 - DNA, 225 bp, Unknown
  Encodes 16S rRNA from Clostridium III
agagtttgatcctggctcaggacgaacgctggcggcgtgcctaacacatgcaagtcgaacgagaagtcttgaaatgattccttcgggatgaatggatagatggacagtggcggacgggcgagtaacgcgtgagtaacctgcccataagcgggggatagccgatggaaacgtcgagtaataccccatgacataattgagtcgcatggcttaattatcaaagattta

SEQ ID NO: 1612 - DNA, 225 bp, Unknown
  Encodes 16S rRNA from Sphingomonas
agagtttgatcatggctcagaacgaacgctggcggcatgcctaacacatgcaagtcgaacgagatcttcggatctagtggcgcacgggtgcgtaacgcgtgggaatctgccctttggttcggaataacagttggaaacgactgctaataccggatgatgacgtaagtccaaagatttatcgccagaggatgagcccgcgtaggattagctagttggtgtggtaag

SEQ ID NO: 1613 - DNA, 225 bp, Unknown
  Encodes 16S rRNA from Selenomonas
agagtttgatcatggctcaggacgaacgctggcggcgtgcttaacacatgcaagtcgaacggggcgattgaaagcttgcttttgagagcctagtggcaaacgggtgagtaacgcgtaggcaacctgccttcgggatggggacaacaggacgaaagccctgctaataccgaatgaagcatcctccctgcatggggagggtatgaaagatggcctctgaatatgcta

SEQ ID NO: 1614 - DNA, 225 bp, Unknown
  Encodes 16S rRNA from Eggerthella
agagtttgatcctggctcaggatgaacgctggcggcgtgcctaacacatgcaagtcgaacgatgaaaccgccctcgggcggacatgaagtggcgaacgggtgagtaacacgtgaccaacctgccccgcgctccgggacagcctcgcgaaagcgggattaataccggatgcgccccggcggccgcatggccgccgggggaaagccctaagcggcgcgggatggggt

SEQ ID NO: 1615 - DNA, 225 bp, Unknown
  Encodes 16S rRNA from Treponema
agagtttgatcatggctcagaacgaacgctggcggcgcgtcttaagcatgcaagtcgggcgggattccccagcttgctggggatgagagcggcggactggtgagtaacgcgtgggcgacgcgccccgtggaccgggatagcctgtggaaacacagggtaataccgggcgagctcccccgcgccggaggcgggggaggaaaggagccgaggctccgccacgggagc

SEQ ID NO: 1616 - DNA, 225 bp, Unknown
  Encodes 16S rRNA from Mogibacterium
agagtttgatcatggctcaggatgaacgctggcggcgtgcctaatacatgcaagtcgagcgagaaattaatcagaggcgttttcggacaagtcagattaatggaaagcggcggacgggtgagtaacgcgtaggcaacctgcccttagcagagggatagccattggaaacgatgattaaaacctcataacgccaactcaacacatgttgagctggccaaagattta

SEQ ID NO: 1617 - DNA, 225 bp, Unknown
  Encodes 16S rRNA from Adlercreutzia
agagtttgatcatggctcaggatgaacgctggcggcgtgcctaacacatgcaagtcgaacagttaaaccggcttcggccggaaatagagtggcgaacgggtgagtaacacgtgaccaacctgccccgcgcaccgggatagccccccgaaagggggattaataccggatgcgccgggagggccgcatggccctcccgggaaagcccaggcggcgcgggatggggtc

SEQ ID NO: 1618 - DNA, 225 bp, Unknown
  Encodes 16S rRNA from Selenomonas
agagtttgatcctggctcaggacgaacgctggcggcgtgcttaacacatgcaagtcgaacgagacgattttaagcttgcttagatgagtcgagtggcaaacgggtgagtaacgcgtagacaacctgccgcaaagatggggacaacagtccgaaaggactgctaataccgaatgttgtcagttttccgcatgggagactgattaaagatggcctctacttgtaagc

SEQ ID NO: 1619 - DNA, 225 bp, Unknown
  Encodes 16S rRNA from Methylomicrobium
agagtttgatcctggctcagattgaacgctggcggcgtgcttaacacatgcaagtcgagcggtagcaggcgtagcaatacgtgctgacgagcggcgaacgggtgagtaatgcttaggaatcttcctcgtagtggggaataacttggggaaactcaagctaataccgcatacgaactacggttgaaagcgggggatcgcaagacctcgcgctatgagatgagccta

SEQ ID NO: 1620 - DNA, 225 bp, Unknown
  Encodes 16S rRNA from Leuconostoc
agagtttgatcctggctcaggatgaacgctggcggcgtgcctaatacatgcaagtcgaacgcacagcgaaaggtgcttgcacctttcaagtgagtggcgaacgggtgagtaacacgtggacaacctgcctcaaggctggggataacatttggaaacagatgctaataccgaatgaaacttagtgtcgcatgacacaaagttaaaaggcgctttggcgtcacctag

SEQ ID NO: 1621 - DNA, 225 bp, Unknown
  Encodes 16S rRNA from Pyramidobacter
agagtttgatcatggctcagattgaacgctggcggcgtgcttaacacatgcaagttgtgcggcgagttttcgaagaagacttcggttggaattggaaatgagcagcagcggacgggtgagtaaagcacaaggacgtgtcctgcagagggggacaactacgggaaaccgcagctaataccccatacgccgagaggtgaaagcagcaatgcgctggaggagcggctt

SEQ ID NO: 1622 - DNA, 225 bp, Unknown
  Encodes 16S rRNA from Butyrivibrio
agagtttgatcctggctcaggatgaacgctggcggcgtgcctaacacatgcaagtcgaacggtgctttgcggtgatgaagcttcggcagattcttgtaaagcatagtggcggacgggtgagtaacgcgtgggcaacctgcctctcagtgggggatagcagctggaaacggctggtaataccgcatatgcgcacggttccgcatggaacagtgtgaaaagatatat

SEQ ID NO: 1623 - DNA, 225 bp, Unknown
  Encodes 16S rRNA from Bacteroides
agagtttgatcctggctcaggatgaacgctagctacaggcttaacacatgcaagtcgaggggcagcgggaggtcagcttgctgacttcgccggcgaccggcgcacgggtgagtaacacgtatccaacctgccgcgcactccgggacagccctctgaaaggaggattaataccggatggtgtcatggagggacatcccttcgtgactaaagattcatcggtgcgcc

SEQ ID NO: 1624 - DNA, 225 bp, Unknown
  Encodes 16S rRNA from Butyricimonas
agagtttgatcatggctcaggatgaacgctagcggcaggcttaacacatgcaagtcgaggggcagcgcgggagtagcaatacacctggcggcgaccggcggaagggtgcgtaacgcgtgagcaacatacccgtcactgggggataacagttggaaacgactcctaataccccataatacaagaggtgacatcatcttttgttgaaagttacggcggtgacggatt

SEQ ID NO: 1625 - DNA, 225 bp, Unknown
  Encodes 16S rRNA from Ruminococcus
agagtttgatcatggctcaggacgaacgctggcggcacgcctaacacatgcaagtcgaacggtgaatacttagcttgctttgtattcatagtggcggacgggtgagtaacacgtgagcaacctgcctctgagagagggatagcttctggaaacggatggtaatacctcatgatatagcgttctcgcatgggaatgttatcaaatgaatttcgctcagagatgggc

SEQ ID NO: 1626 - DNA, 225 bp, Unknown
  Encodes 16S rRNA from Clostridium sensu stricto
agagtttgatcctggctcaggacgaacgctggcggcgcgcctaacacatgcaagtcgaacgggactagtgaccggagcttagaggtaatttgtctaggttgcgatcactagttcagtggcggacgggtgagtaaagcatgagtaactttcccataagtggggaatagcttttggaaacagaagataataccgcataaatcgttgagggcacatgctcacaacgga

SEQ ID NO: 1627 - DNA, 225 bp, Unknown
  Encodes 16S rRNA from Butyrivibrio
agagtttgatcctggctcaggatgaacgctggcggcgtgcctaacacatgcaagtcgaacggggttatctcgccgttgaagcttcggcagagacatgaggtaacttagtggcggacgggtgagtaacgcgtgggcaacctgccccgtaccgggggatagcagttggaaacgactgataataccgcataagcgcacggtgtggcatcacacagtgtgaaaaactcc

SEQ ID NO: 1628 - DNA, 225 bp, Unknown
  Encodes 16S rRNA from Corynebacterium
agagtttgatcatggctcaggatgaacgctggcggcgtgcttaacacatgcaagtcgaacggaaaggcctcagcttgctggggtactcgagtggcgaacgggtgagtaacacgtgggtgatctgccctgcactttgggataagcccgggaaactgggtctaataccgaatatgaccacttcttggatgttgtggtggaaagcttttgcggtgtgggatgagcctg

SEQ ID NO: 1629 - DNA, 225 bp, Unknown
  Encodes 16S rRNA from Proteiniborus
agagtttgatcctggctcaggatgaacgctggcggcgtgcttaacacatgcaagtcgagcgagaactcgctcagccgattcttcggaagaaagcagagcgacggaaagcggcggacgggtgagtaacgcgtgggaaacctgccctgtgcagggggacagccgagggaaacttcgattaataccccataacaccaaagcatcgcatggtgcaatggtcaaagattt

SEQ ID NO: 1630 - DNA, 225 bp, Unknown
  Encodes 16S rRNA from Spirochaeta
agagtttgatcctggctcagaacgaacgctggcggcgcgtcttaagcatgcaagtcgagcgggaagaagtagcttgctacttctgagagcggcggactggtgagtaacgcgtgggtgacgcacccctgtgtcggggacagcccgtggaaacacggagtgataccggatacggtcccatggatcagaaacatgggaggaaaggagctacggcttcgcacggggagc

SEQ ID NO: 1631 - DNA, 225 bp, Unknown
  Encodes 16S rRNA from Acetitomaculum
agagtttgatcctggctcaggatgaacgctggcggcgtgcctaacacatgcaagtcgaacggggtatagacgctgaagaggtttcgactgattcttgtttatacttagtggcggacgggtgagtaacgcgtgggcaacctgccctgtactgggggatagcagctggaaacggctggtaataccgcataagcgcacgataccgcatggtatagtgtgaaaagctcc

SEQ ID NO: 1632 - DNA, 225 bp, Unknown
  Encodes 16S rRNA from Selenomonas
agagtttgatcctggctcaggacgaacgctggcggcgtgcttaacacatgcaagtcgaacggggcgattagaagcttgcttttatgagcctagtggcaaacgggtgagtaacgcgtaggcaacctgcctttgggatggggacaacaggacgaaagccctgctaataccgaatgaagtagtctttccgcatggagggactatgaaagatggcctctacatgtaagc

SEQ ID NO: 1633 - DNA, 225 bp, Unknown
  Encodes 16S rRNA from Altererythrobacter
agagtttgatcctggctcagaacgaacgctggcggcatgcttaacacatgcaagtcgaacggtaatgtatagtacttgtattatatattatagtggcaaacgggtgagtaacgcgtggggacgtacccttcagtaatgaataacggatggaaacgtacgctaatacattataggattgagagatgaaagagagatcgctgagggagcggcccgcgttagattagg

SEQ ID NO: 1634 - DNA, 225 bp, Unknown
  Encodes 16S rRNA from Atopobium
agagtttgatcatggctcaggatgaacgctggcggcgcgcctaacacatgcaagtcgaacggttaagaccccttcgggggtgaataaagtggcgaacggctgagtaacacgtgggcaacctacctcttgctctgggatagcctcgggaaaccgtgggtaataccggatactctgtaactgtcgcatggcggatacaggaaagcgcatacggcaagagatgggccc

SEQ ID NO: 1635 - DNA, 225 bp, Unknown
  Encodes 16S rRNA from Clostridium IV
agagtttgatcctggctcaggacgaacgctggcggcgtgcctaacacatgcaagtcgaacggacttagttggatgcttgcatccggcgacagttagtggcggacgggtgagtaacgcgtgaataacctgcccaacagagggggataacgtttggaaacgaacgctaataccgcataacattatggtaccgcatggtattataatcaaaggagcaatccgctgatg

SEQ ID NO: 1636 - DNA, 225 bp, Unknown
  Encodes 16S rRNA from Clostridium XlVa
agagtttgatcatggctcaggatgaacgctggcggcgtgcctaacacatgcaagtcgagcggaccttagagagtgaacagcttgctgggatctttcgaaaggttagcggcggacgggtgagtaacgcgtgggtaacctgcctcatacagggggatagcagttggaaacgactggtaataccgcataagcgcacagtaccgcatggtatagtgtgaaaaactccgg

SEQ ID NO: 1637 - DNA, 225 bp, Unknown
  Encodes 16S rRNA from Clostridium XlVa
agagtttgatcatggctcaggatgaacgctggcggcgtgcctaacacatgcaagtcgaacgggaacctcatagtggagacttcggtcaaagcagtgagaattctagtggcggacgggtgagtaacgcgtggataacctgcctttaagaattggataacagtgagaaatcattgctaatacaatataagcttacagtctcgcatgagacagtgagaaaagatttat

SEQ ID NO: 1638 - DNA, 225 bp, Unknown
  Encodes 16S rRNA from Clostridium IV
agagtttgatcatggctcaggatgaacgctggcggcgtgcataacacattcaagtcgaacgggactaaaccgattaatccttcgggaagcgttgatttagtttagtggcggacgggtgagtaacgcgtgagcaacctgccttgaagagggggataacacagggaaacttgtgctaataccgcataacatatgacgatcgcatggtcgacatatcaaagctccgac

SEQ ID NO: 1639 - DNA, 225 bp, Unknown
  Encodes 16S rRNA from Clostridium III
agagtttgatcctggctcaggacgaacgctggcggcgtgcctaacacatgcaagtcgaacgagaagtcttgaaatgatcccttcggggtgaatggatagatggacagtggcggacgggcgagtaacgcgtgagtaacctgcccataagagagggatagccgatggaaacgtcgagtaatacctcatattgtagttaattcgcatggattgattatgaaagattta

SEQ ID NO: 1640 - DNA, 225 bp, Unknown
  Encodes 16S rRNA from unknown taxa
agagtttgatcatggctcaggatgaatgctggcggcgtgcctaatacatgcaagtcgagcggtaacagggggactcaccgtgctcttgacactcttgcctatgaggaagaggtcggatcgagagtacagtgagtccctgctgacgagcggcggacggctgagtaacgcgtgggaacataccccaaactgagggataactagtcgaaagattagctaataccgcat

SEQ ID NO: 1641 - DNA, 225 bp, Unknown
  Encodes 16S rRNA from Desulfotomaculum
agagtttgatcatggctcaggacgaacgctggcggcgtgcttaatacatgcaagtcgaacggagatattccgccgttcaaggtttcggctgagaacatgggatatcttagtggcgaacgggtgagtaacgcgtgaacaacctgactcaaagagggggataacaacgggaaactgttgctaataccgcataagaccacagtgtcgcatggcacaggggtcaaagat

SEQ ID NO: 1642 - DNA, 225 bp, Unknown
  Encodes 16S rRNA from Pedobacter
agagtttgatcctggctcaggatgaacgctagcggcaggcctaatacatgcaagtcggacggtaagtgccccttcgggggcacgagagtggcggacgggtgcgtaacgcgtatgcaaccaacccccgtcatccggatagccggtggaaacgccggataatacggaatgaacccttcggtgggcatccaccggagggcaaggcggcgacgcggacggggacgggca

SEQ ID NO: 1643 - DNA, 162 bp, Unknown
  Encodes 16S rRNA from Bacteroides
agagtttgatcatggctcaggatgaacgctagctacaggcttaacacatgcaagtcgaggggcagcatgaactcgagaaagggtgctgttcaaatagggcagtattcagatgttagaaaaagaataagtaccggcaaactccgtgccagcagccgcggtaat

SEQ ID NO: 1644 - DNA, 225 bp, Unknown
  Encodes 16S rRNA from Asaccharobacter
agagtttgatcatggctcaggatgaacgctggcggcgtgcttaacacatgcaagtcgaacgggaaagcgccctcgggcgcgagtacagtggcgaacgggtgagtaacacgtgaccaacctgccccccgcaccgggatagccgggcgaaagcccgggtaataccggatgaccccgcaccgcggcatcgcggcgcgggcaaagcccagacggcgggggatggggtcg

SEQ ID NO: 1645 - DNA, 225 bp, Unknown
  Encodes 16S rRNA from Microbacterium
agagtttgatcatggctcaggacgaacgctggcggcgtgcttaacacatgcaagtcgaacggtgaaggcggagcttgctctgctggatcagtggcgaacgggtgagtaacacgtgagcaatctgccccgaactctgggataagcgctggaaacggcgtctaataccggatacgacacgggagggcatcctctccgtgtggaaagatttttcggttcgggatgagc

SEQ ID NO: 1646 - DNA, 225 bp, Unknown
  Encodes 16S rRNA from Treponema
agagtttgatcatggctcagaacgaacgccggcggcgcgtcttaagcatgcaagtcgggcgggatcagggtgcttgcaccctgtgagagcggcggactggcgaggaacgcgtgggcgacgtgccctccgcaccgggacagccggcagaaatgccgggtgatacgggatgagctcgtgcgatgtggtgttgtacgaggaaagctgccacggcagcggcggaggagc

SEQ ID NO: 1647 - DNA, 225 bp, Unknown
  Encodes 16S rRNA from Dethiosulfovibrio
agagtttgatcatggctcaggatgaacgctggcggcgtgcataacacattcaagtcgaacgaagcactttggcggaagccttcgggtggaagctgatttgacttagtggcggacgggtgagtaacgcgtgagcaacctgcctggctgtgagggataacacagggaaacttgtgctaataccacatgacgcatggagatcgcatgttttccatgccaaagatatat

SEQ ID NO: 1648 - DNA, 225 bp, Unknown
  Encodes 16S rRNA from Oscillibacter
agagtttgatcatggctcaggacgaacgctggcggcgtgcctaacacatgcaagtcgaacgaagctctttgaagggcggcttcggccaaacggatgagatgacttagtggcgaacgggtgagtaacgcgtgaggaacctgcctttcagtgggggacaacagttggaaacgactgctaataccgcataacgtacagaggtcgcatgaccattgtaccaaagattta

SEQ ID NO: 1649 - DNA, 225 bp, Unknown
  Encodes 16S rRNA from Selenomonas
agagtttgatcatggctcaggacgaacgctggcggcgtgcttaacacatgcaagtcgaacgagggaattagaagcttgcttttatgacccgagtggcaaacgggtgagtaacgcgtagacaacctgcctctcagatggggacaacagcccgaaagggctgctaataccgaatgttgtatttcttccgcatggaggagatattaaagatggcctctacttgtaagc

SEQ ID NO: 1650 - DNA, 225 bp, Unknown
  Encodes 16S rRNA from Eubacterium
agagtttgatcctggctcaggacgaacgctggcggcgtgcttaacacatgcaagtcgaacgaagcttgacgaatgattccttcgggatgatttctgatatgactgagtggcggacgggtgagtaacgcgtgagtaacctgcctcttggagggggatagtgtttggaaacgaacagtaataccgcataacgtgtacggatggcatcttctgtataccaaagattta

SEQ ID NO: 1651 - DNA, 225 bp, Unknown
  Encodes 16S rRNA from Ruminococcus
agagtttgatcctggctcaggacgaacgctggcggcacgcttaacacatgcaagtcgaacggagatattcccttcgggggataacttagtggcggacgggtgagtaacacgtgagcaacctgccttacagagaggaataatgactggaaacggtcactaatacctcataaaatatttgaatcgcatggtttggatatcaaagaataatcgctgtaagatgggctc

SEQ ID NO: 1652 - DNA, 225 bp, Unknown; identical to SEQ ID NO: 265
  Encodes 16S rRNA from Treponema

SEQ ID NO: 1653 - DNA, 225 bp, Unknown
  Encodes 16S rRNA from Spirochaeta
agagtttgatcatggctcagaacgaacgctggcggcgcgtcttaagcatgcaagtcgagcggcaagacagtgcttgcactgtcctagagcggcggactggtgagtaacacgtgggttacgtaccctccggacggggatagcctgtggaaacacagggtaataccggatacggcggcacagcatggagttgtgtcgggaaaggagcttcggctccgccggaggatc

SEQ ID NO: 1654 - DNA, 225 bp, Unknown
  Encodes 16S rRNA from Roseburia
agagtttgatcatggctcaggatgaacgctggcggcgtgcctaacacatgcaagtcgagcggacctgattaagtgattagcttgctaagaacttatgactggttagcggcggacgggtgagtaacgcgtgggtaacctgcctcatacagggggatagcagttggaaacgactggtaataccgcataagcgcacggtaccgcatggtacagtgtgaaaaactccgg

SEQ ID NO: 1655 - DNA, 225 bp, Unknown
  Encodes 16S rRNA from Ruminococcus
agagtttgatcatggctcaggacgaacgctggcggcgcgcctaacacatgcaagtcgaacggggcacgatttagatttcttcggaatgatagattattgcttagtggcggacgggtgagtaatacgtgagtaatctgccttatagatggggataacgatcagaaatggtcgctaataccctataatgtatgttttccgcatggttagcataccaaagggattcgc

SEQ ID NO: 1656 - DNA, 225 bp, Unknown
  Encodes 16S rRNA from Butyricimonas
agagtttgatcctggctcaggatgaacgctagcggcaggcttaacacatgcaagtcgaggggcagcgcgattgtagcaatacgattggcggcgaccggcgcaagggtgcgtaacgcgtgagcaacatacccgcaacagggggataagcgatggaaacgtcgtctaataccccatggagaccaagggcggcatcgtccatggcctaaacccacgggggttgcggat

SEQ ID NO: 1657 - DNA, 225 bp, Unknown
  Encodes 16S rRNA from Pedobacter
agagtttgatcatggctcaggatgaacgctagcggcaggcctaatacatgcaagtcgaacgggagggggcccttcggggcctccgagagtggcgcacgggtgcgtaacgcgtatgcaaccaaccccgcactgggggacagccggtggaaacgccgggtaataccccatgccgacgggaggggacatccccatccgttgaaaggcttcggtcggtgcgggacgggc

SEQ ID NO: 1658 - DNA, 225 bp, Unknown
  Encodes 16S rRNA from Spirochaeta
agagtttgatcctggctcagaacgaacgctggcggcgcgtcttaagcatgcaagtcgaacggcaagatggagcttgctccatcctagagtggcggactggtgagtaacacgtgggtgacatgcctttcagttggggatagctactagaaatagtagataataccgaatacggtggcatatcttggaagtatgccaagaaaggagctaaggctccgctgagagatt

SEQ ID NO: 1659 - DNA, 225 bp, Unknown
  Encodes 16S rRNA from Parabacteroides
agagtttgatcctggctcaggatgaacgctagcgacaggcttaacacatgcaagtcgaggggcagcggggaggtagcaatacttccgccggcgaccggcgcactggtgagtaacacgtatgcaacctgcccccggttggggaataacccgcggaaacgcggactaatgccccgtatgcatggccgccgcatgacggccatgtgatagaacttcgtccggggatgg

SEQ ID NO: 1660 - DNA, 225 bp, Unknown
  Encodes 16S rRNA from Methylococcus
agagtttgatcatggctcagattgaacgctggcggcatgcctaacacatgcaagtcgaacgggagtaaggggcaactcttactctagtggcggacgggtgaggaatacgtaggaatctaccttagagtgggggataactcggggaaactcgagctaataccgcatatgttctacggagtaaagggggcgcaagctctcgctttaagatgagcctacgtcggatta

SEQ ID NO: 1661 - DNA, 225 bp, Unknown
  Encodes 16S rRNA from Enterorhabdus
agagtttgatcatggctcaggatgaacgctggcggcgtgcctaacacatgcaagtcgaacggtgaaaccgcctccgggcggacatgaagtggcgaacgggtgagtaacacgtgaccaacctgccccgcgcaccgggacagccccccgaaagggggattaataccggatactccggccgggccgcatggcccggccgggaaagctccggcggcgcgggatggggtc

SEQ ID NO: 1662 - DNA, 225 bp, Unknown
  Encodes 16S rRNA from Clostridium sensu stricto
agagtttgatcctggctcaggacgaacgctggcggcgtgcttaatacatgcaagtcgaacggatatgtagcaatacatattagtggcggacgggtgagtaacgcgtaatcaacctgccctttacaggggaataacacttggaaacaggtgctaataccgcatatgaccacaacacggcatcgtgaaggggtaaaagttttatcggtaaaggagggggttgcgtat

SEQ ID NO: 1663 - DNA, 225 bp, Unknown
  Encodes 16S rRNA from Gelidibacter
agagtttgatcctggctcaggataaacgctagcggcaggcctaacacatgcaagtcgagcggcagcgggatgtagcaatacattgccggcgagcggcggacgggtgagtaacgcgtatgcaacctgcccaccacacggagatagccgaccgaaaggacgattaaactccgatggcattgggacccggcatcgggatccaattaaatattcataggtggtggatgg

SEQ ID NO: 1664 - DNA, 225 bp, Unknown
  Encodes 16S rRNA from Sporobacter
agagtttgatcatggctcaggatgaacgctggcggcgtgcctaacacatgcaagtcgaacgaagcacaatggaaggagacttcggtcaacggaagttgtgacttagtggcggacgggtgagtaacgcgtgagcaacctgcctcagagtgggggacaacagctggaaacggctgctaataccgcataatactttcggaaggcatcttctgaaagtcaaagctttat

SEQ ID NO: 1665 - DNA, 225 bp, Unknown
  Encodes 16S rRNA from Pedobacter
agagtttgatcctggctcaggatgaacgctagcggcaggcctaatacatgcaagtcgtacggtaagcggtccttcgggactgcgagagtggcggacgggtgcgtaacgcgtatgcaaccaacccccctcgccgggatagccggtggaaacgccggataataccggatgcgccgcgtgggaggcatctcccgagcggcaaggcggagacgcggagggggacgggca

SEQ ID NO: 1666 - DNA, 225 bp, Unknown
  Encodes 16S rRNA from unknown taxa
agagtttgatcctggctcaggatgaacgctagctacaggcttaacacatgcaagtcgaacgagaaatacacttcggtgtatggaaagtggcggacgggtgagtaatgtgtagagaatctgccctgaagagggggacaacagagggaaacttctgctaataccccatatgcgcgtagttgagatactattcgtgaaagatttatcgcttcaggatgagtctgcatc

SEQ ID NO: 1667 - DNA, 225 bp, Unknown
  Encodes 16S rRNA from Syntrophococcus
agagtttgatcatggctcaggatgaacgctggcggcgtgcttaacacatgcaagtcgaacggacttgcccaccgaagcggaaggtgcttgcattcgaagcttcaccgggcaggttagtggcggacgggtgagtaacgcgtggggaacctgccccgtaccgggggataacagttagaaatgactgctaataccgcataagcgcacactgaggcatctcagagtgtg

SEQ ID NO: 1668 - DNA, 225 bp, Unknown
  Encodes 16S rRNA from Slackia
agagtttgatcctggctcaggatgaacgccggcggcgcgcctaacacatgcaagtcgagcggaggacccgccctcgggcgggcgatcagcggcgaacgggtgagtaacgcgtgggcaacctgccccccgcacgggaatagccccgggaaaccgggggtaatgcccgacggcccggcagaggggcatccctctgccggcgaagccatcgcggcgggggatgggccc

SEQ ID NO: 1669 - DNA, 225 bp, Unknown
  Encodes 16S rRNA from Mogibacterium
agagtttgatcctggctcaggatgaacgctggcggcgtgcctaacacatgcaagtcgagcgagaaatctatgtgatgaaacttcggtcgaatcttttagatggaaagcggcggacgggtgagtaacgcgtaggcaacctgcccttagcagggggatagccattggaaacgatgattaaaaccccataatacggatttatcacatgttgaatccgtcaaagattta

SEQ ID NO: 1670 - DNA, 225 bp, Unknown
  Encodes 16S rRNA from Prevotella
agagtttgatcatggctcaggatgaacgctagctacaggcttaacacatgcaagtcgaggggcagcacgtgggtagcaataccctgggtggcgaccggcgcacgggtgagtaacgcgtatccaacctggcccatagtagggaacagcccggcgaaagtcggattaatgccctatgttttcctcagtgagcattttatgaggaacaaagacttgtcgctatgggat

SEQ ID NO: 1671 - DNA, 225 bp, Unknown
  Encodes 16S rRNA from Pseudoflavonifractor
agagtttgatcatggctcaggacgaacgctggcggcgtgcttaacacatgcaagtcgagcggagatgaattgaatgagagcttcggcaggatttcgattgatcttagcggcggacgggtgagtaacgcgtgaacaatctgtcccacacagggggataacacttcgaaagaagtgctaataccgcataagaccacggtgccgcatggcacaggggtaaaagaaatt

SEQ ID NO: 1672 - DNA, 225 bp, Unknown
  Encodes 16S rRNA from Veillonella
agagtttgatcctggctcaggatgaacgctggcggcgtgcttaatacatgcaagtcgaacggatgattcggtctagcttgctagatcggagagtcagtggcgaacgggtgagtaatacgtaggcaacctgccccaaagcgggggatagcagttggaaacgactattaataccgcataggtaatctcgaggcatcttgagattattaaaggtgcgtttgcaccgct

SEQ ID NO: 1673 - DNA, 225 bp, Unknown
  Encodes 16S rRNA from Clostridium XlVa
agagtttgatcctggctcaggatgaacgctggcggcgtgcttaacacatgcaagtcgaacgaagcacttttccttgattcttcggatgaaaaggaaatttgactgagtggcggacgggtgagtaacgcgtgggtaacctgccctgtacagggggataacagttagaaatgactgctaataccgcataagaccacagcatcgcatggtgcaggggtaaaaactccg

SEQ ID NO: 1674 - DNA, 225 bp, Unknown
  Encodes 16S rRNA from Bacillus
agagtttgatcatggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcactta

SEQ ID NO: 1675 - DNA, 225 bp, Unknown
  Encodes 16S rRNA from Pedobacter
agagtttgatcatggctcaggatgaacgctagcggcaggcctaatacatgcaagtcgaacggtaaacgccccttcgggggcgtgagagtggcggacgggtgcgtaacgcgtatgcaaccaacccccctcaccgggatagccggtggaaacgccggataagaccggatgcgccgctggggaggcatctccccggcggcaaggcggcgacgcggagggggacgggca

SEQ ID NO: 1676 - DNA, 225 bp, Unknown
  Encodes 16S rRNA from Clostridium IV
agagtttgatcatggctcaggatgaacgctggcggcgtgcctaacacattcaagtcgaacggagaagggagcttcggttcccggatcagtggcggacgggtgagtaacgcgtgagcaacctgccttcgtgtggggaataacacagggaaacttgtgctaataccgcataatgcaaagacgcagcattacgtttttgccaaagatttatcgcatgaagatgggctc

SEQ ID NO: 1677 - DNA, 225 bp, Unknown
  Encodes 16S rRNA from Fibrobacter
agagtttgatcatggctcagaacgaacgctggcggcgtgccttatacatgcaagtcgagcgagggcgcagcaatgcgaaccgagcggcgaacgggtgagtaacgcgtgaacaacctgccccaaagtccgggatagcccttccaacggaggattaataccggatggcgagggtttccgcatggagacctatccaaagtcttggcgctatgggaggggttcgcgtcc

SEQ ID NO: 1678 - DNA, 225 bp, Unknown
  Encodes 16S rRNA from Paenibacillus
agagtttgatcatggctcaggattaacgctggcaccatgcctaatacatgcatgtcgagcggagtttagagagcttgctttctaaacttagcggcaaatgggtgagtaacacgtaaggaacctgcctaagtgacgaggacaacggttggaaacgactgctaatactggatagtataagaaaccgcatgatttcttatttaaaggtccgtttggaccacgcttaga

SEQ ID NO: 1679 - DNA, 225 bp, Unknown
  Encodes 16S rRNA from Brevundimonas
agagtttgatcatggctcaggacgaacgctggcggtgtgcctcatacatgcaagtcgaacgataaggttccttcgggaatacataagtggcggacgggtgagtacaacataggaaatctgccctaaactgggggacaacagagggaaacttctgctaataccccatacgagataagttgaaatatttatcttgaaagctccggcggtttaggatgagcctgtgcc

SEQ ID NO: 1680 - DNA, 225 bp, Unknown
  Encodes 16S rRNA from Desulfovibrio
agagtttgatcctggctcagattgaacgctggcggcgtgcttaacacatgcaagtcgaacgcgaaaggggcttcggccccaagtagagtggcgcacgggtgagtaacgcgtggataatctgcccctgcaactggaatagcgactggaaacggtcgataataccggatacgcccttgttgtacaacgaggggaaaggagacctctgcttgcaagtttccgtgcagg

SEQ ID NO: 1681 - DNA, 225 bp, Unknown
  Encodes 16S rRNA from Clostridium XI
agagtttgatcctggctcaggacgaacgctggcggcgtgcctaacacatgcaagtcgagcggagacataaggaacggaggcttcggccgaagggagctatgttttagcggcggacgggtgagtaacgcgtgaacgatctgtcccttacagggggataacacatggaaacaggtgctaataccgcataagaccacagagctgcatggctcaggggtcaaaggagga

SEQ ID NO: 1682 - DNA, 225 bp, Unknown
  Encodes 16S rRNA from Helicobacter
agagtttgatcatggctcagagtgaacgctggcggcgtgcctaatacatgcaagtcgaacgatgaagcttttagcttgctagaagtggattagtggcgcacgggtgagtaatgcataggttatgtgccctttagtctgggatagccactggaaacggtgattaatactagatactccctacgggggaaagtttttcgctaaaggatcagcctatgtcctatcagc

SEQ ID NO: 1683 - DNA, 225 bp, Unknown
  Encodes 16S rRNA from Prevotella
agagtttgatcatggctcaggatgaacgctagctacaggcttaacacatgcaagtcgaggggcagcacgtgggtagcaataccctgggtggcgaccggcgcacgggtgagtaacgcgtatccaacctggcccatagtagggaacagcccggcgaaagtcggattaatgccctatgttttcctcagggagcattttatgaggaacaaagacttgtcgctatgggat

SEQ ID NO: 1684 - DNA, 225 bp, Unknown
  Encodes 16S rRNA from Clostridium XlVa
agagtttgatcctggctcaggatgaacgctggcggcgtgcctaacacatgcaagtcgaacggtgaaagaagactgaagccttcgggcggaagttttttggatcagtggcggacgggtgagtaacgcgtggataacctgcctcatacagggggataacagggagaaatcactgctaataccgcataagcgcacaggaccgcatggtctggtgtgaaaaacttcggt

SEQ ID NO: 1685 - DNA, 225 bp, Unknown
  Encodes 16S rRNA from Prevotella
agagtttgatcctggctcaggatgaacgctagcggcaggcttaacacatgcaagtcgaggggcagcgggttgtagcaatacaatgccggcgaccggcgtaagggtgagtaacgcgtgagcgacgtgcccgtcacagggggacaagcgctggaaacggcgtctgataccccataggaatgctccctgcatggggggtgtttgaaagatttatcggtgacggatcgg

SEQ ID NO: 1686 - DNA, 225 bp, Unknown
  Encodes 16S rRNA from Herbiconiux
agagtttgatcctggctcaggatgaacgctggcggcgtgcttaacacatgcaagtcgaacggtgaaagcgggagcttgctcctgctggatcagtggcgaacgggtgagtaacacgtgagtaacctgcccttgactctgggataagcgttggaaacgacgtctaataccggatacgaccttcggaggcatctcctggaggtggaaagaatttcggtcaaggatgga

SEQ ID NO: 1687 - DNA, 225 bp, Unknown
  Encodes 16S rRNA from Clostridium IV
agagtttgatcatggctcaggacgaacgctggcggcgtgcctaacacattcaagtcgaacggtgaaggaagcttgcttccggatcagtggcggacgggtgagtaacgcgtgagcaacctgccctgcattgggggataacacagggaaacttgtgctaatacctcatgacacatacttaccgcatgataggtatgtcaaagagcaatcgatgcaggatgggctcgc

SEQ ID NO: 1688 - DNA, 225 bp, Unknown
  Encodes 16S rRNA from Rikenella
agagtttgatcatggctcaggatgaacgctagcggcaggcttaacacatgcaagtcgaggggcagcgcgtggtagcaataccatggcggcgaccggcgcacgggtgcgtaacgcgtatgcaacctgcctgtaacagggggataacccggagaaatttggactaataccgcatattgccgagctgcagcattgcaattcggcgaaaggagcgatccggttacagat

SEQ ID NO: 1689 - DNA, 225 bp, Unknown
  Encodes 16S rRNA from Clostridium XlVa
agagtttgatcatggctcaggatgaacgctggcggcgtgcctaacacatgcaagtcgaacggggtacagacgctgcgagaggaagtgcttgcacggaatcaaacttgtttgtacttagtggcggacgggtgagtaacgcgtggaaaacctgcctcatacagggggataacaggaagaaattcctgctaataccgcatgagcgcacattaccgcatggtagagtgt

SEQ ID NO: 1690 - DNA, 225 bp, Unknown
  Encodes 16S rRNA from Hippea
agagtttgatcctggctcagagttaacgctggcggcgtgcctaacacatgcaagtcgagcgaattcttacagagcatcgtaagagttagcggcaaacgggtgagtaacacatgggaaacctcccttagaatggggaatatctccgtgaaaacggagctaataccgcataagaccacagtttggcatcaaacaggggtaaaagcagcaatgcgttctaagatggtc

SEQ ID NO: 1691 - DNA, 225 bp, Unknown
  Encodes 16S rRNA from Lactobacillus
agagtttgatcctggctcaggacgaacgctggcggcatgcctaatacatgcaagtcgaacgaaccaaactgaagattgatgcttgcatcatgattcagaccttggtgagtggcggacgggtgagtaacacgtgggtaacctgcccaaaagtgggggataacatttggaaacaagtgctaataccgcataacaactactttcacatgatcgtagcttgaaagatgg

SEQ ID NO: 1692 - DNA, 225 bp, Unknown
  Encodes 16S rRNA from Eubacterium
agagtttgatcatggctcaggacgaacgctggcggcgtgcttaacacatgcaagtcgaacgaagcttgattttagatttcttcggaatgataaatgatatgactgagtggcggacgggtgagtaacgcgtgagcaacctgcccttcggagggggatagcgtttggaaacgaacggtaataccgcataatgttaacggaaggcatcttctgttaaccaaaactccg

SEQ ID NO: 1693 - DNA, 225 bp, Unknown
  Encodes 16S rRNA from Clostridium IV
agagtttgatcatggctcaggacgaacgctggcggcgtgcctaacacatgcaagtcgaacggggctgaagatggcacaggctcacctggggagtcaggtgggcgcgtgtcgtcttcagcttagtggcggacgggtgagtaacgcgtgagcgacctgacccatacagggggacaacagctggaaacggctgctaataccgcataagaccacgtacctgagggtatg

SEQ ID NO: 1694 - DNA, 225 bp, Unknown
  Encodes 16S rRNA from Clostridium III
agagtttgatcctggctcaggacgaacgctggcggcgtgcctaacacatgcaagtcgaacgagaaatatggaaatgattccttcggggagaatggaaatatggacagtggcggacgggcgagtaacgcgtgagtaacctgcccataagcgggggatagccgatggaaacgtcgagtaataccccatgacataattgagtcgcatggcttaattatcaaagattta

SEQ ID NO: 1695 - DNA, 225 bp, Unknown
  Encodes 16S rRNA from Lactobacillus
agagtttgatcatggctcaggacgaacgctggcggcatgcctaatacatgcaagtcgaacgaaccatcctgaagattgaagcttgcttcatgattcagatcttggtgagtggcggacgggtgagtaacacgtgggtaacctgcccaaaagtgggggataacatttggaaacaagtgctaataccgcataacaactactttcgcatgatcgtagtttaaaagatgg

SEQ ID NO: 1696 - DNA, 225 bp, Unknown
  Encodes 16S rRNA from Lactobacillus
agagtttgatcatggctcaggacgaacgctggcggcgtgcctaatacatgcaagtcgagcgagcagaaccagcagatttacttcggtaatgacgctggggacgcgagcggcggatgggtgagtaacacgtggggaacctgccccatagtctgggataccacttggaaacaggtgctaataccggataagaaagcagatcgcatgatcagcttataaaaggcggcg

SEQ ID NO: 1697 - DNA, 225 bp, Unknown
  Encodes 16S rRNA from Desulfotomaculum
agagtttgatcctggctcaggacgaacgctggcggcgtgcttaatacatgcaagtcgaacggagatattccgccgttcaaggtttcggctgagaacatgggatatcttagtggcgaacgggtgagtaacgcgtgaacaacctgactcaaagagggggataacaacgggaaactgttgctaataccgcataagaccacgccctcgcatgggggaggggtaaaagat

SEQ ID NO: 1698 - DNA, 225 bp, Unknown
  Encodes 16S rRNA from Prevotella
agagtttgatcatggatggggatgcgtaggattaggcagtcggcggggtaacggcccaccgagccgacgatccttaggggttctgagaggaaggtcccccacactggtactgagacacggaccagactcctacgggaggcagcagtgaggaatattggtcaatggtcggaagactgaaccagccaagtagcgtgcaggatgacggccctacgggttgtaaactgc

SEQ ID NO: 1699 - DNA, 225 bp, Unknown
  Encodes 16S rRNA from Staphylococcus
agagtttgatcatggctcaggatgaacgctggcggcgtgcctaatacatgcaagtcgagcgaacagacgaggagcttgctcctttgacgttagcggcggacgggtgagtaacacgtgggtaacctacctataagactgggataacttcgggaaaccggagctaataccggataatatttcgaaccgcatggttcgatagtgaaagatggctctgctatcacttat

SEQ ID NO: 1700 - DNA, 225 bp, Unknown
  Encodes 16S rRNA from Tenacibaculum
agagtttgatcctggctcaggatgaacgctagcggcaggcttaacacatgcaagtcgaggggtaacaggcggtagcaatactgtgctgacgaccggcgcacgggtgcgtaacgcgtatgcaacctgcccgcgacagggggataacggagggaaacttccactaatatcccatggtgccggggtctcgcatggggccgcggctaaaggggcgacccggttgcggat

SEQ ID NO: 1701 - DNA, 225 bp, Unknown
  Encodes 16S rRNA from Parabacteroides
agagtttgatcctggctcaggatgaacgctagcgacaggcttaacacatgcaagtcgaggggcagcggggcgtggcaacacgccgccggcgaccggcgcactggtgagtaacacgtatgcaacctgcccatcggagggggataacccgtggaaacgcggcctaataccccgtacgcctttggatcgcatgatttggaggtgaaaggaggcgactctgtcgatgga

SEQ ID NO: 1702 - DNA, 225 bp, Unknown
  Encodes 16S rRNA from Clostridium XlVa
agagtttgatcatggctcaggacgaacgctggcggcgtgcctaacacatgcaagtcgaacggagacgaggcataagcttcccttcggggaagccgtttcgtcttagtggcggacgggtgagtaacgcgtggacaacctgccgtatgctgggggacaacagcgggaaactgctgctaataccgcataagccggggagggggcatccccatcccgggaaagatttat

SEQ ID NO: 1703 - DNA, 225 bp, Unknown
  Encodes 16S rRNA from Clostridium IV
agagtttgatcatggctcaggatgaacgctggcggcgtgcataacacattcaagtcgaacggacttagaggggcttgctcctcgaaagttagtggcggacgggtgagtaacgcgtgagcaacctgcctttttccgggggataacatcgggaaaccggtgctaataccgcataacgtacaggaaccgcatgatttttgtaccaaagattcattgggaaaagatggg

SEQ ID NO: 1704 - DNA, 225 bp, Unknown
  Encodes 16S rRNA from Clostridium IV
agagtttgatcatggctcaggacgaacgctggcggcgtgcctaacacatgcaagtcgaacggacttagctggatgcttgcatccggcgacagttagtggcggacgggtgagtaacgcgtgaataacctgcccaacagagggggataacgtttggaaacgaacgctaataccgcataatattatgatatcgcatggtattataatcaaaggagcaatccgctgatg

SEQ ID NO: 1705 - DNA, 225 bp, Unknown
  Encodes 16S rRNA from Pedobacter
agagtttgatcatggctcaggatgaacgctagcggcaggcctaatacatgcaagtcggacggtaagtgccctttcgggggcacgagagtggcggacgggtgcgtaacgcgtatgcaaccaacccccgtcttccggatagccggtggaaacgccggataatacggaatgaacccgaggaggggcatcccttcgcgggcaaggcggcgacgcggacggggacgggca

SEQ ID NO: 1706 - DNA, 225 bp, Unknown
  Encodes 16S rRNA from Helicobacter
agagtttgatcatggctcagagtgaacgctggcggcgtgcctaacacatgcaagtcgcgcgggactttacagagtatcgtaaagtctagcggcaaacgggtgagtaacacgtgggaaacctccctcagaatggggaatatctccgggaaaccggagtcaataccgcataagaccacagtttggcatcaaacaggggtcaaagcagtaatgcgttttgagatggtc

SEQ ID NO: 1707 - DNA, 225 bp, Unknown
  Encodes 16S rRNA from Proteiniclasticum
agagtttgatcatggctcaggacgaacgctggcggcgtgcctaacacatgcaagtcgagcggggacataattggaaaggcttcggcccggaaggttatgttccagcggcggacgggtgagtaacgcgtgaacaatctgtcccagacaggggaataacagatggaaacatctgctaataccgcataagaccacgacccgacatcgggatgaggtaaaaggagcaat

SEQ ID NO: 1708 - DNA, 225 bp, Unknown
  Encodes 16S rRNA from Anaplasma
agagtttgatcctggctcagaacgaacgctggcagtatgctttaaccatgcaagtcgaacgagaaagtgtagcaatatatgagtaaagtggcaaacgggtgagtaacacacaggaatctacccagtagagaggaataagcactagaaatggtgtctaatacctcataagccaatatagtaaaatatattgggaaaggattagtagtaatattaattcactattgg

SEQ ID NO: 1709 - DNA, 225 bp, Unknown
  Encodes 16S rRNA from Bacteroides
agagtttgatcatggctcaggatgaacgctagctacaggcttaacacatgcaagtcgaggggcatcatggggttggtttcggccgatcctgatggcgaccggcggatgggtgagtaacgcgtatccaacctgcccctgtcccgcggacagcccttagaaatgaggattaacccgcgatgttgcccctttgccgcatggtattggggtgaaatttttaaggacggg

SEQ ID NO: 1710 - DNA, 225 bp, Unknown
  Encodes 16S rRNA from Clostridium IV
agagtttgatcatggctcaggacgaacgctggcggcgtgcctaacacatgcaagtcgaacggagtattccgcccgagaccagatgtagcttgctacggatgggatcaatagggatacttagtggcggacgggtgagtaacgcgtgaataacctgcccaacagagggggataacgtttggaaacgaacgctaataccgcataacattacggtatcgcatggtacag

SEQ ID NO: 1711 - DNA, 225 bp, Unknown
  Encodes 16S rRNA from Mucilaginibacter
agagtttgatcatggctcaggatgaacgctagcggcaggcctaatacatgcaagtcgaacgggattgcctccttcgggaggcatgagagtggcgcacgggtgcgcaacgcgtatgcaaccaacccccgacaggcggatagccggtggaaacgccggataatacgccatggttccggtggagggcatcctctactggataaagccgagaggcggtcggggacgggc

SEQ ID NO: 1712 - DNA, 225 bp, Unknown
  Encodes 16S rRNA from unknown taxa
agagtttgatcatggctcagaacgaacgctggtagcgtggattaggcatgcaagtcgaacgggatccgggaggtagcaatacttcctggtgagagtggcggattggggaggaacacgtgagcaacctgcccttgagttggggaaaaccgttggaaacgacggctaataccggatgcggcgccccgtgacatcgcgggagcgctaaagggggccgcaaggctcccg

SEQ ID NO: 1713 - DNA, 225 bp, Unknown
  Encodes 16S rRNA from Selenomonas
agagtttgatcctggctcaggacgaacgctggcggcgtgcttaacacatgcaagtcgaacggggcgattgagagcttgctcttgaaagcctagtggcaaacgggtgagtaacgcgtaggcaacctgcctccaagatggggacaacagtccgaaaggactgctaataccgaatgttgtaccttaaccgcatggtgaaggtattaaagatggcctctatatataagc

SEQ ID NO: 1714 - DNA, 225 bp, Unknown
  Encodes 16S rRNA from Parabacteroides
agagtttacatggctcaggatgaacgctagcgacaggcctaacacatgcaagtcgcggggcagcattgaggtagcaatacttcagatggcgaccggcgcacgggtgcgtaacgcgtatccaacctggcccttactcgggtatagccctgcgaaagtaggattaatccccgatgttgtcaagatggagccttttttcttgaccaaaggcattagtcggtaagggat

SEQ ID NO: 1715 - DNA, 225 bp, Unknown
  Encodes 16S rRNA from Eubacterium
agagtttgatcatggctcaggatgaacgctggcggcgtgcctaacacatgcaagtcgagcgagatatccatgacgaattcttcggatgcctgaatggatggaaagcggcggacgggtgagtaacgcgtaggtaacctgccctgtacaaagggatagccactggaaacggtgattaataccttatgacaccgcagcatcccatggtgaagcggtcaaagattttat

SEQ ID NO: 1716 - DNA, 225 bp, Unknown
  Encodes 16S rRNA from Coprococcus
agagtttgatcatggctcaggatgaacgctggcggcgtgcttaacacatgcaagtcgaacgaagcacctcaaccgaagaagagaccagcttgctggtattggattcacccgaggtgacttagtggcgaacgggtgagtaacgcgtgggtaacctacctcttacagggggataacaattagaaatgattgctaataccgcataacactttagagccgcatggctca

SEQ ID NO: 1717 - DNA, 225 bp, Unknown
  Encodes 16S rRNA from Weissella
agagtttgatcatggctcaggatgaacgctggcggcgtgcctaatacatgcaagtcgaacgctttgtttttaattgatatgaagagcttgctctgatttgattttatctgacaaagagtggcgaacgggtgagtaacacgtgggtaacctacctcttagcaggggataacatttggaaacaagtgctaataccgtataacactaacaaccgcatggttgttagtt

SEQ ID NO: 1718 - DNA, 225 bp, Unknown
  Encodes 16S rRNA from Pedobacter
agagtttgatcatggctcaggatgaacgctagcggcaggcctaatacatgcaagtcgtacggtaaaatcctcttcgggggattgagagtggcggacgggtgcgtaacgcgtatgcaaccaacccccctcgccgggatagccggtggaaacgccggataataccggatgcgccgcgtgggaggcatctcccgtgcggcaaggcggagacgcggagggggacgggca

SEQ ID NO: 1719 - DNA, 225 bp, Unknown
  Encodes 16S rRNA from Clostridium XI
agagtttgatcatggctcaggacgaacgctggcggcgtgcctaacacatgcaagtcgagcggggacatacggaacgagggattcgtcccgagggaaatatgtttcagcggcggacgggtgagtaacgcgtgaacgatctgtccctgacagggggataacacatggaaacaggtgctaataccgcataagaccacagcgctgcatggcgcaggggtcaaaggagag

SEQ ID NO: 1720 - DNA, 225 bp, Unknown
  Encodes 16S rRNA from Sphingomonas
agagtttgatcctggctcagaaggaacgctagctatatgcttaacacatgcaagtcgaacgttgttttcggggagctgggcagaaggaaaagaggctcctagcgtgaaggttgcttgtctcgcccaggaggtgggaacagttgaaaacaaagtggcgaacgggtgcgtaatgcgtgggaatctgccgaacagttcgggccaaatcctgaagaaagctaaaaagcg

SEQ ID NO: 1721 - DNA, 225 bp, Unknown; identical to SEQ ID NO: 789
  Encodes 16S rRNA from Treponema

SEQ ID NO: 1722 - DNA, 225 bp, Unknown
  Encodes 16S rRNA from Geobacter
agagtttgatcatggctcagaacgaacgctggcggcaggcctaacacatgcaagtcgaacgtgaaaggggcttcggccctgagtaaagtggcgcacgggtgagtaacacgtgaataatctgcccttatgtctgggatagcagaccgaaaggactggtaaccccggataagcttccgcaccaaccgggtgagtggagaaaaatacgggatcgcaagaccgtatgca

SEQ ID NO: 1723 - DNA, 225 bp, Unknown
  Encodes 16S rRNA from Clostridium XlVa
agagtttgatcatggctcaggatgaacgctggcggcgtgcttaacacatgcaagtcgaacgaagatatatcagcagaggccttcgggcggatgcagatatatacttagtggcggacgggtgagtaacgcgtggagaacctgccgtatgcagggggacaacacctggaaacgggtgctaataccgcataagcgcacgtgatagcattatcgagtgtgaaaagctta

SEQ ID NO: 1724 - DNA, 225 bp, Unknown
  Encodes 16S rRNA from Filomicrobium
agagtttgatcatggctcagagcgaacgctagcggaatgctttatacatgcaagtcgaacgaacgagtttatattgagtagcaatacgatttataaatgagttagtggcaaacgggtgagtaatagttaggaacttgccgaatagtgggggacaacagatagaaatgtctgctaataccgcatattcccgagaggggaaagatttattgctatttgagaggccta

SEQ ID NO: 1725 - DNA, 225 bp, Unknown
  Encodes 16S rRNA from Prevotella
agagtttgatcatggctcaggatgaacgctagctacaggcttaacacatgcaagtcgaggggaaacgacagagagtgcttgcactttttgggcgtcgaccggcgaatgggtgagtaacgcgtatccaacctgcccttgactgagggatagcccagtgaaaactgaattaatacctcatatcctcctccgacggcatcagacgaggagtaaagatttatcggtcaa

SEQ ID NO: 1726 - DNA, 225 bp, Unknown
  Encodes 16S rRNA from Pedobacter
agagtttgatcatggctcaggatgaacgctagcggcaggcctaatacatgcaagtcggacggtaagtgccctttcgggggcacgagagtggcggacgggtgcgtaacgcgtatgcaaccaacccccgtcttccggatagccggtggaaacgccggataatacggaatgaaccctttggggggcatcccctggagggcaaggcggcgacgcggacggggacgggca

SEQ ID NO: 1727 - DNA, 225 bp, Unknown
  Encodes 16S rRNA from Pedobacter
agagtttgatcatggctcaggatgaacgctagcggcaggcctaatacatgcaagtcggacggtaagcgccccttcgggggcgcgagagtggcgcacgggtgcgtaacgcgtatgcaaccagccccgtccaggcggatagccggtggaaacgccggataatacgccacggtcccggaggggggcatccctttccgggtgaagcggagacgcgggacgggacgggca

SEQ ID NO: 1728 - DNA, 225 bp, Unknown
  Encodes 16S rRNA from Clostridium XlVa
agagtttgatcatggctcaggatgaacgctggcggcgtgcctaacacatgcaagtcgaacgaagaccccgaggcagagatttcggtcgaagccaagggaggactgagtggcggacgggtgagtaacgcgtggataacctgccccatacagggggatagcagttggaaacgactgataataccgcataagcgcacggggagacatctcctagtgtgaaaagagata

SEQ ID NO: 1729 - DNA, 225 bp, Unknown
  Encodes 16S rRNA from Bifidobacterium
agagtttgatcatggctcaggatgaacgctggcggcgtgcttaacacatgcaagtcgaacgggatcggctggagcttgctccggccgtgagagtggcgaacgggtgagtaatgcgtgaccgacctgccccatacaccggaatagctcctggaaacgggtggtaatgccggatgctccagttggatgcatgtccttctgggaaagattctatcggtatgggatggg

SEQ ID NO: 1730 - DNA, 225 bp, Unknown
  Encodes 16S rRNA from Saccharofermentans
agagtttgatcatggctcaggatgaacgctggcggcgtgcctaacacatgcaagtcgaacgaaaaactttcaccgaatgaaagatgaagattcatcagattctggatttcaccgaaagtttttagtggcggacgggtgagtaatacgtagataatctgccttctagagggaaataacagagagaaatttctgctaatgtcccataagaccacactatggcatctt

SEQ ID NO: 1731 - DNA, 225 bp, Unknown
  Encodes 16S rRNA from Ruminococcus
agagtttgatcctggctcaggacgaacgctggcggcacgcttaacacatgcaagtcgaacggagtataggagcttgcttttatacttagtggcggacgggtgagtaacacgtgagcaacctgcctttcggagaggaataatgattggaaacggtcactaatacctcataaaatatatttatcgcatggtgagtatatcaaagatttatcgccgagagatgggctc

SEQ ID NO: 1732 - DNA, 225 bp, Unknown
  Encodes 16S rRNA from Flavobacterium
agagtttgatcatggctcaggatgaacgctagcgacaggcctaacacatgcaagtcgaggggcagcgggaggtggcaacaccttgccggcgaccggcgcacgggtgcgtaacgcgtatgcaacctgtccgggacagtgggacagccccccgaaagggggattaataccgcatggctcttcaggaccgcatggtcttgaaggtaaacattcatgggtcccggctgg

SEQ ID NO: 1733 - DNA, 225 bp, Unknown
  Encodes 16S rRNA from Rhodopirellula
agagtttgatcctggctcagaatgaacgttggcggcgtggattaggcatgcaagtcgagcgggagtagcaatactccagcggcgaaagggatagtaacgcgtagttaccaacccccgggactgggatagcttttggaaacgaaaggtaataccagataacatctccggatcaaaggtgagattccgcctggggacgggactgcgtcctattagttagttggtgag

SEQ ID NO: 1734 - DNA, 225 bp, Unknown
  Encodes 16S rRNA from Roseburia
agagtttgatcctggctcaggagaaacgctggcggcgcacataagacatgcaagtcgaacggaatccagccaaatgtttaccatgaggcgaagatttagtggcggacgggtgagtaacacgtgagcaacctaccttcaggagggggataacattgagaaatcagtgctaataccgcataatactatgagaagacatcttcacatagtcaaaggatttccgcctaa

SEQ ID NO: 1735 - DNA, 225 bp, Unknown
  Encodes 16S rRNA from Prevotella
agagtttgatcatggctcaggacgaacgctggcggcacgcttaacacatgcaagtcgaggggcatcaggacggtagcttgctatcgttgctggcgaccggcgcacgggtgagtaacgcgtatccaaccttcccatgactccggttcagcccgccgaaaggcggattactcccggatggtttccgaagagggcatctgatttggaataaagattgatcggtcatgg

SEQ ID NO: 1736 - DNA, 225 bp, Unknown
  Encodes 16S rRNA from Limibacter
agagtttgatcatggctcaggatgaacgctagcggcaggcctaatacatgcaagtcgtacggtaagcgccccttcgggggtgcgagagtggcggacgggtgcgtaacgcgtatgcaaccaacccccctcgccgggatagccggtggaaacgccggataataccggatgcgccgcaggggaggcatcttcccggcggcaaggcggagacgcggagggggacgggca

SEQ ID NO: 1737 - DNA, 225 bp, Unknown
  Encodes 16S rRNA from Saccharofermentans
agagtttgatcatggctcaggacgaacgctggcggcgtgcctaacacatgcaagtcgagcgaggacaacggcttcggtcgttgttcgagcggcggacgggtgagtaacgcgtgaacaatctgtccctgacagggggataacacttggaaacaggtgctaataccgcataagaccacaggaccgcatggttcaggggtcaaaggagcaatccggtgaggggtgagt

SEQ ID NO: 1738 - DNA, 225 bp, Unknown
  Encodes 16S rRNA from Clostridium sensu stricto
agagtttgatcatggctcaggacgaacgctggcggcgtgcttaacacatgcaagtcgaacgaggtgtagcaatacaccgagtggcggacgggtgagtaacgcgtgagcaacctgcccttgtcaggggaataacacagagaaatctgtgctaataccgcatgacgttgaatcaaggcatcttgaatcaaccaaagcgaataagcggacaaggatgggctcgcgtcc

SEQ ID NO: 1739 - DNA, 225 bp, Unknown
  Encodes 16S rRNA from Clostridium III
agagtttgatcatggctcaggatgaacgctggcggcgcacataagacatgcaagtcgaacgaacttaggctctttcttttagttagagtacggttagtggcggactggtgagtaatgtataagcaacctgcctatcagaggggaataacagtgagaaatcattgctaataccgcatatgctaacagaatcgcatgatttagttaggaaaggagtaatccgctgat

SEQ ID NO: 1740 - DNA, 225 bp, Unknown
  Encodes 16S rRNA from Prevotella
agagtttgatcatggctcaggatgaacgctagctacaggcttaacacatgcaagtcgaggggcagcgggggcttagcttgctaagcttgccggcgaccggcgcacgggtgagtaacgcgtatccaaccttcccgcaggtagggaacagcccggcgaaagtcggattaatgccctatgaattcctttgatggcatctgatgaggaataaagatttatcgcctgcgg

SEQ ID NO: 1741 - DNA, 225 bp, Unknown
  Encodes 16S rRNA from Pseudoxanthomonas
agagtttgatcatggctcagagtgaacgctggcggtaggcctaacacatgcaagtcgaacggcagcacaggagagcttgctctctgggtggcgagtggcggacgggtgaggaatacatcggaatctactctgtcgtgggggataacgtagggaaacttacgctaataccgcatacgacctacgggtgaaagtgggggaccgcaaggcctcacgcgatagaatgag

SEQ ID NO: 1742 - DNA, 225 bp, Unknown
  Encodes 16S rRNA from Anaerorhabdus
agagtttgatcctggctcaggatgaacgctggcggcgtgcttaatacatgcaagtcgaacggacgctctgacaagcttgcttgaaagagtagtgcgtggcgaacgggtgagtaatacataggcaacctgccccgatgagcgggataaccaatggaaacgttggataataccgcataggtaatccgaaggcatctttggattattaaagtcgcgtttgcggcactt

SEQ ID NO: 1743 - DNA, 225 bp, Unknown
  Encodes 16S rRNA from Clostridium III
agagtttgatcatggctcaggacgaacgctggcggcgtgcctaacacatgcaagtcgaacgagaaatgatgatttgattccttcgggatgaaaagattcatggacagtggcggacgggcgagtaacgcgtgagtaacctgcccataagagagggatagccgatggaaacgtcgagtaatacctcatattgtaatttgatcgcatgattgaattatgaaagattta

SEQ ID NO: 1744 - DNA, 225 bp, Unknown
  Encodes 16S rRNA from Streptomyces
agagtttgatcctggctcaggacgaacgctggcggcgtgcttaacacatgcaagtcgaacgatgaaccggcttcggccggggattagtggcgaacgggtgagtaacacgtgggcaatctgccctgcactctgggacaagccctggaaacggggtctaataccggatacgaccgtttgaggcatctcatggcggtggaaagctccggcggtgcaggatgagcccgc

SEQ ID NO: 1745 - DNA, 225 bp, Unknown
  Encodes 16S rRNA from Pedobacter
agagtttgatcatggctcaggatgaacgctagcggcaggcctaatacatgcaagtcgaacggtaaatgtcccttcggggacatgagagtggcggacgggtgcgtaacgcgtatgcaaccaacccccctcaccgggatagccggtggaaacgccggataagaccggatgcgccggcggggaggcatctccctgtcggcaaggcggcgacgcggagggggacgggca

SEQ ID NO: 1746 - DNA, 225 bp, Unknown
  Encodes 16S rRNA from Cellulomonas
agagtttgatcatggctcaggacgaacgctggcggcgtgcttaacacatgcaagtcgaacggtgaagaccagcttgctggttggatcagtggcgaacgggtgagtaacacgtgagcaacctgcccttcactctgggataagccttggaaacggggtctaataccggatatgacgtccctacgcatgtgggggtgtggaaagatttatcggtgggggatgggctcg

SEQ ID NO: 1747 - DNA, 225 bp, Unknown
  Encodes 16S rRNA from Clostridium XlVa
agagtttgatcatggctcaggatgaacgctggcggcgtgcctaacacatgcaagtcgaacgaagcatgttggaaagagtccttcgggacgatggaagacatgacttagtggcggacgggtgagtaacgcgtgggcaacctgccgtacacagggggacaacagctggaaacggctgctaataccgcataagcgcacagctttgcatgaagcagtgtgaaaagcgca

SEQ ID NO: 1748 - DNA, 225 bp, Unknown
  Encodes 16S rRNA from Olivibacter
agagtttgatcatggctcaggatgaacgctagcggcaggcctaatacatgcaagtcgtacggtaaacggtccttcgggaccgtgagagtggcggacgggtgcgtaacgcgtatgcaaccaacccccctcgccgggatagccggtggaaacgccggataataccggatgcgccgcgtgggaggcatctcccgtgcggcaaggcggagacgcggagggggacgggca

SEQ ID NO: 1749 - DNA, 225 bp, Unknown
  Encodes 16S rRNA from Treponema
agagtttgatcctggctcagaacgaacgctggcggcgcgtcttaagcatgcaagtcgagcggcaagttggtgcttgcaccaacccagagcggcggactggtgagtaacgcgtgggtgacgcaccctccggacggggacagcccgtggaaacacggggtaataccggatacggcggcatgggctggagccatgccgggaaaggagcttcggctccgccgggggagc

SEQ ID NO: 1750 - DNA, 225 bp, Unknown
  Encodes 16S rRNA from Gelidibacter
agagtttgatcatggctcaggataaacgctagcggcaggcctaacacatgcaagtcgagcggcagcgggatgtagcaatacattgccggcgagcggcggacgggtgagtaacgcgtatgcaacctgcccaccacacggagatagccgaccgaaaggacgattaaactccgatggcattgggagccggcatcggcatccaattaaatatttataggtggtggatgg

SEQ ID NO: 1751 - DNA, 225 bp, Unknown
  Encodes 16S rRNA from Ruminococcus
agagtttcatcctggctcaggatgaacgctagctacaggcttaacacatgcaagtcgaacggagaatgcttagcttgctttgcgttcttagtggcggacgggtgagtaacacgtgagcaacctgccttttggcgagggatagcttctggaaacggatggtaatacctcataaatatagctgaatcgcatgatttagttatcaaagaatttcgccaaaagatgggc

SEQ ID NO: 1752 - DNA, 225 bp, Unknown
  Encodes 16S rRNA from Clostridium IV
agagtttgatcatggctcaggacgaacgctggcggcgtgcttaacacatgcaagtcgaacgagaatctgtggaaggagttttcggacaacggaaacagaggaaagtggcggacgggtgagtaacgcgtgaggaacctgccttggagagggggacaacagctggaaacggctgctaataccgcatgatgcgtgagggagacatctcccacacgccaaagatttatc

SEQ ID NO: 1753 - DNA, 225 bp, Unknown
  Encodes 16S rRNA from Gemmatimonas
agagtttgatcctggctcaggacgaacgctggcggcgtgcttaacacatgcaagtcacgggggcccgcaagggtaaccggcgaacgggtgcgtaacacgtgagcaatctgccgtacactgggggatagccggcccaacggccgggtaataccgcatacgttccctgtctggcatcggatggggaggaaacctccgggggtgtacgaggagctcgcggcctatcag

SEQ ID NO: 1754 - DNA, 225 bp, Unknown
  Encodes 16S rRNA from Prevotella
agagtttgatcatggctcaggatgaacgctagctacaggcttaacacatgcaagtcgaggggcagcatgaaggaagcttgcttcctttgatggcgaccggcgcacgggtgagtaacgcgtatccaaccttcccttaacttgggaatagcccggtgaaaaccggattaatgcccgatgtggtccagcgagggcatctgacccggaccaaagattttttcggttaag

SEQ ID NO: 1755 - DNA, 225 bp, Unknown
  Encodes 16S rRNA from Ethanoligenens
agagtttgatcatggctcaggacgaacgctggcggcatgcctaacacatgcaagtcgaacggagcaaagagggcttgccctttttgcttagtggcggacgggcgagtaacgcgtgagcaacctgcccctcagaggggaataacgtccggaaacggacgctaataccgcataacgcagcgggaccgcatggttctgctgccaaaggagcaatccgctgagggatgg

SEQ ID NO: 1756 - DNA, 225 bp, Unknown
  Encodes 16S rRNA from Leucobacter
agagtttgatcatggctcaggacgaacgctggcggcgtgcttaacacatgcaagtcgaacgatgaagcccagcttgctgggtggaagagtggcgaacgggtgagtaacacgtgagtaacctgcccctgactctgggataagcgctggaaacggcgtctaatactggatatgagcaatggccgcatggtctgttgttggaaagatttatcggttggggatggactc

SEQ ID NO: 1757 - DNA, 184 bp, Unknown
  Encodes 16S rRNA from Clostridium XlVa
agagtttgatcctggctcaggataaacgctggcggcgtgctttgcacaatgggggaaaccctgatgcagcgacaccgcgtgagcgatgaaatatttcggtatgtaaagctctatcagcagggaagataatgacggtacctgactaagaagcaccggctaaatacgtgccagcagccgcggtaat

SEQ ID NO: 1758 - DNA, 225 bp, Unknown
  Encodes 16S rRNA from Clostridium XlVa
agagtttgatcctggctcaggatgaacgctggcggcgtgcctaatacatgcaagtcgagcgaagcgcctgcttctgatctttcgggtgaagaaacaggcgactgagcggcggacgggtgagtaacacgtagggaacctgcctcacacagggggataacagttagaaatgactgctaataccgcataagcgcacaggaccgcatggtctggtgtgaaaagctccgg

SEQ ID NO: 1759 - DNA, 225 bp, Unknown
  Encodes 16S rRNA from Eggerthella
agagtttgatcctggctcaggatgaacgctggcggcgtgcttaacacatgcaagtcgaacgattaacccatcttcggatggttatagagtggcgaacgggtgagtaacacgtgatcaacctacctttcactttgggataactacgggaaactgtagctaataccaaatactcctggggttccgcatggcgccctagggaaagttccggcggtgaaagatgggatc

SEQ ID NO: 1760 - DNA, 225 bp, Unknown
  Encodes 16S rRNA from Prevotella
agatttgatcatggctcaggatgaacgctagctacaggcttaacacatgcaagtcgaggggtaacggcagtgaagcttgctttactggccgacgaccggcgcacgggtgagtaacgcgtatccaacctgcccatgactcagggataaccttccgaaagggagcctaatacctgatgttgtgagacgagggcatctgagtgtcaccaaagattcatcggtcatgga

SEQ ID NO: 1761 - DNA, 225 bp, Unknown
  Encodes 16S rRNA from Prevotella
agagtttgatcatggctcaggatgaacgctagctacaggcttaacacatgcaagtcgaggggcagcatgggagttgcttgcaacttctgatggcgaccggcgcacgggtgagtaacgcgtatccgaccttccctcaggtagggaacagcccggcgaaagtcggattaatgccctatagtctgcgaattgcgcatgttgtttgcagtaaagatttatcgcctgggg

SEQ ID NO: 1762 - DNA, 225 bp, Unknown
  Encodes 16S rRNA from Solobacterium
agagtttgatcatggctcaggataaacgctggcggcgtgcctaatacatgcaagtcgaacgatgaagttctcaagcttgcttgagaatagattagtggcgaacgggtgagtaatacataagcaacctacccatgaagactgggataatctctggaaacggggactaataccggataggtaagcggaccgcatgatctgcttattaaaggttaaaaacactgatgg

SEQ ID NO: 1763 - DNA, 225 bp, Unknown
  Encodes 16S rRNA from Xanthobacter
agagtttgatcctggctcagagcgaacgctggcggcaggcctaacacatgcaagtcgagcgcccggcaacgggagcggcagacgggtgagtaacgcgtggggatctacccattggtacggaataacccagggaaacttggactaataccgtatgtgtccttttggagaaagatttatcgccaatggatgaacccgcgtcggattagctagttggtggggtaaagg

SEQ ID NO: 1764 - DNA, 225 bp, Unknown
  Encodes 16S rRNA from unknown taxa
agagtttgatcctggctcagaacgaacgctggtagcgtggattaggcatgcaagtcgaacgggatccatgaagtagcaatacggattggtgagagtggcggaagggcgaggaacacgtgagcaacctgtccttgaggtggggaaaaccgttggaaacgacggctaataccgaatgtggcgcccggagacatctccggagcgctaaagggggcccaaaaggctctc

SEQ ID NO: 1765 - DNA, 225 bp, Unknown
  Encodes 16S rRNA from Desulfovibrio
agagtttgatcctggctcagattgaacgctggcggcgtgcttaacacatgcaagtcgaacgcgaaaggggcttcggccccgagtagagtggcgcacgggtgagtaacgcgtggataatctgcccctgtgactggaatagcgactggaaacggtcgataataccggatacgcccttgttgaacgatgaggggaaaggagacctctgcttgcaagtttccgtgcagg

SEQ ID NO: 1766 - DNA, 225 bp, Unknown
  Encodes 16S rRNA from Microbacterium
agagtttgatcctggctcaggatgaacgctggcggcgtgcttaacacatgcaagtcgaacggtgaaagcggagcttgctctgctggatcagtggcgaacgggtgagtaacacgtgagcaatctgcccttgactctgggataagcgctggaaacggcgtctaataccggatacgagctgcgaaggcatcttcagcagctggaaagaacttcggtcaaggatgagct

SEQ ID NO: 1767 - DNA, 225 bp, Unknown
  Encodes 16S rRNA from Oscillibacter
agagtttgatcatggctcaggatgaacgctggcggcgtgcctaacacatgcaagtcgaacgaagcattctggaaggagacttcggtcaacggaagggatgacttagtggcggacgggtgagtaacgcgtgagcaacctgcctcagagtgggggacaacagctggaaacggctgctaataccgcatgatacttttggaaggcatcttctgaaagtcaaagctttat

SEQ ID NO: 1768 - DNA, 225 bp, Unknown
  Encodes 16S rRNA from Blautia
agatttgatcatggctcaggatgaacgctggcggcgtgcctaacacatgcaagtcgaacggagatcttatggaaagcggcttcggccaatggatatctgatcttagtggcggacgggtgagtaacgcgtggggaacctgccctgtactgggggataacacccagaaatgagtgctaataccgcataagcgcacagtaccgcatggtacagtgtgaaaaactccgg

SEQ ID NO: 1769 - DNA, 225 bp, Unknown
  Encodes 16S rRNA from Papillibacter
agagtttgatcatggctcaggacgaacgctggcggcgtgcttaacacatgcaagtcgaacggagttatttccgacacggagccactgaggaattagtggttgcgtgttggggataacttagtggcgaacgggtgagtaacgcgtaagcaatctgccttacagagggggataacgtttggaaacgaacgctaataccgcataacgtcatgaagaggcatcttttta

SEQ ID NO: 1770 - DNA, 225 bp, Unknown
  Encodes 16S rRNA from Prevotella
agagtttgatcatggctcaggatgaacgctagctacaggcttaacacatgcaagtcgaggggcagcatgaagtttgcttgcaaactttgatggcgaccggcgcacgggtgagtaacgcgtatccgaccttccccctgcccaggtatagtccgctgaaaggcggtttaatccctggtgctgtcctgcgggtgcatgccatcgggacgaaaggatttccggcagggg

SEQ ID NO: 1771 - DNA, 225 bp, Unknown
  Encodes 16S rRNA from Lentisphaera
agagtttgatcatggctcagaatgaacgctggcggcatggattaggcatgcaagtcgaacgccccgggctttgcccggggagtggcgaaagggtgcgcaacgcgtggggaacccgcccccgggcccgggacaagcgctggaaacggcgtctgatacgggatgtcgagccgggccgcatggcccggcgtcgaaagattcatcgcccggggagggccccgcgtccca

SEQ ID NO: 1772 - DNA, 225 bp, Unknown
  Encodes 16S rRNA from Ruminococcus
agagtttgatcatggctcagattgaacgctggcggcacgcttaacacatgcaagtcgaacgggactaagagagaagcttgcttcacttttagtttagtggcggacgggtgagtaacacgtgagtaacctgcccttatcaggggaatagcctccggaaacggagagtaataccgcataagatgacgatgtggcatcacatagtcataaaagattttatcggataag

SEQ ID NO: 1773 - DNA, 225 bp, Unknown
  Encodes 16S rRNA from Bacteroides
agagtttgatcctggctcaggatgaacgctagcggcaggcttaacacatgcaagtcgaggggcagcgtgggggtagcaatactcccgacggcgaccggcgcacgggtgagtaacgcgtatgcaacctttcccagacagggggatagcccagggaaacttggattaataccccgtaggccagaagagggcatcctcatctggttaaagttccggcggtctggggtg

SEQ ID NO: 1774 - DNA, 225 bp, Unknown
  Encodes 16S rRNA from Catonella
agagtttgatcatggctcaggatgaacgctggcggcgtgcctaacacatgcaagtcgaacggggacgtcccgccgttgaagcttcggcagagacatgggacatcctagtggcggacgggtgagtaacgcgtgggcaacctgccctgtactgggggatagcagctggaaacggctggtaataccgcataagcgcacagtgtcgcatgacacagtgtgaaaagctcc

SEQ ID NO: 1775 - DNA, 225 bp, Unknown
  Encodes 16S rRNA from Clostridium XlVa
agagtttgatcctggctcaggatgaacgctggcggcgtgcttaatacatgcaagtcgaacggaagttattgggagcttgctcttgatgactttagtggcggacgggtgagtaacgcgtgggtaacctgcctcatacagggggataacagttagaaatgactgctaaaaccgcataacatgatggaaccgcatgatttcatcatcaaatatttataggtatgagat

SEQ ID NO: 1776 - DNA, 225 bp, Unknown
  Encodes 16S rRNA from Clostridium IV
agagtttgatcatggctcaggacgaacgctggcggcgtgcctaacacatgcaagtcgaacggagttaacaatggaagttccttcggggacggaagctgttaacttagtggcggacgggtgagtaacgcgtgagtaacctgcctttcagagggggataacgttcggaaacgaacgctaataccgcataacatagcgataccgcatggtaatgctatcaaaggagca

SEQ ID NO: 1777 - DNA, 225 bp, Unknown
  Encodes 16S rRNA from unknown taxa
agagtttgatcatggctcagaacgaacgctggtcgcgtggattaggcatgcaagtcgaacgggatccatgaagtagcaatacggattggtgagagtggcggaagggcgaggaacacgtgggcaacctgtctttgaggtggggaaaacctcgggaaactgaggctaataccgaatgtggcgcggaagggcatccttcctgcgctaaagggggcgaaagctccccct

SEQ ID NO: 1778 - DNA, 225 bp, Unknown
  Encodes 16S rRNA from Clostridium XI
agagtttgatcatggctcaggatgaacgctggcggcgtgcttaacacatgcaagtcgaacggagatacgtaaaagaagttttcggatggaatttacatatcttagtggcggacgggtgagtaacacgtaaacaatctgcctttgagagcgggataacagatagaaatatttgctaataccgcataagaccacaacatcgcatgatgaaggggtaaaaggggagca

SEQ ID NO: 1779 - DNA, 225 bp, Unknown
  Encodes 16S rRNA from Prevotella
agagtttgatcatggctcaggatgaacgctagctacaggcttaacacatgcaagtcgaggggtaacgggcagcagtgcttgcactgctgtgctgacgaccggcgcacgggtgagtaacgcgtatccaaccttcccatgagtagtgcatagcccggcgaaagtcggattaattcactatatgtggcatttcggcatctttatgtcacgaaagattcatcgctcatg

SEQ ID NO: 1780 - DNA, 225 bp, Unknown
  Encodes 16S rRNA from unknown taxa
agagtttgatcatggctcaggatgaatgctggcggcgtgcctaatacatgcaagtcgagcggtaacagggggactcaccgtactcttgacactcttgcccagagaggaagaggtcggatcgagggtacagtgagtccccgctgacgagcggcggacggctgagtaacgcgtgggaacataccccaaactgagggataactagtcgaaagattagctaataccgca

SEQ ID NO: 1781 - DNA, 225 bp, Unknown
  Encodes 16S rRNA from Mogibacterium
agagtttgatcctggctcaggatgaacgctggcggcgtgcctaatacatgcaagtcgagcgagaagccaatttgaagcgttttcggacaattctgtttggtggaaagcggcggacgggtgagtaacgcgtaggcaacctgcccttagcagagggatagccattggaaacgatgattaaaacctcataatgccgattcaacacatgttgaaccggccaaagattta

SEQ ID NO: 1782 - DNA, 225 bp, Unknown
  Encodes 16S rRNA from Clostridium XlVa
agagtttgatcctggctcaggatgaacgctggcggcgtgcctaacacatgcaagtcgaacggggtttagatgaaacctagtgattctaaacctagtggcggacgggtgagtaacgcgtgggtaacctgccgtatgcagggggacaacagttggaaacgactgctaataccgcataagcgcacagcttcacatggagcagtgtgaaaagatttatcggcatacgat

SEQ ID NO: 1783 - DNA, 225 bp, Unknown
  Encodes 16S rRNA from Ruminococcus
agatttgatcctggctcaggacgaacgctggcggcacgcttaacacatgcaagtcgaacgggactaagagagaagcttgcttcacttttagtttagtggcggacgggtgagtaacacgtgagtaacctgcccttatcaggggaatagcctctggaaacggagagtaataccgcataagatggcaatgtggcatcacatagtcataaaagattttatcggataagg

SEQ ID NO: 1784 - DNA, 225 bp, Unknown
  Encodes 16S rRNA from Eubacterium
agagtttgatcatggctcaggattaacgctggcggcgtgcctaacacatgcaagtcgagcgagaaatagtgatatgaaacttcggtagattggatctatggacagcggcggacgggtgagtaacgcgtgggcaacctgcccctttctggaggatagccaagggaaactttgaataatactccataacgcaagagcatcgcatggtgcacttgccaaagatttatc

SEQ ID NO: 1785 - DNA, 225 bp, Unknown
  Encodes 16S rRNA from Clostridium IV
agagtttgatcctggctcaggacgaacgctggcggcgtgcctaacacatgcaagtcgagcggagacataccacgaagtgaaagttttcggacggaagcggagagatatgttttagcggcggacgggtgagtaacgcgtgagcaacctgtccctcacagggggataacacatcgaaaggtgtactaataccgcatgagaccacggcgggacatctcgcaggggtca

SEQ ID NO: 1786 - DNA, 225 bp, Unknown
  Encodes 16S rRNA from Rhodomicrobium
agagtttgatcctggctcagaacgaacgctggcggcaggcttaacacatgcaagtcgaacgcgtgcagcaatgcacgagtggcgcacgggtgagtaacgcgtggatatctgccttttggttcggaataaccccgggaaactggggctaataccggatggttcctacgggataaagatttatcgccaaaagatgagtccgcgtccgattagctagttggtggggta

SEQ ID NO: 1787 - DNA, 225 bp, Unknown
  Encodes 16S rRNA from Butyricicoccus
agagtttgatcatggctcaggacgaacgctggcggcgtgcctaacacatgcaagtcgaacggagaacccacgaacgagttttcggacaagtaagtggaattcttagtggcggacgggtgagtaacgcgtgagcaacctgcctttcagagggggataacagtgggaaaccactgctaataccgcataacgtatatataaggcatcttagatataccaaaggagcaa

SEQ ID NO: 1788 - DNA, 225 bp, Unknown
  Encodes 16S rRNA from Saccharofermentans
agagtttgtcctggctcaggatgaacgctggcggcgtgcttaacacatgcaagtcgaacggagatatatgtatgaagttttcggatggaatgtatatatcttagtggcggacgggtgagtaacgcgtaaacaatctgccttagagagggggataacagatagaaatatctgctaataccgcataagaccacgtacaggcatctagacggggtaaaaggagcaatc

SEQ ID NO: 1789 - DNA, 225 bp, Unknown
  Encodes 16S rRNA from Prevotella
agagtttgatcatggctcaggatgaacgctagctacaggcttaacacatgcaagtcgaggggcagcatgggagttgcttgcaattcccgatggcgaccggcggatgggtgagtaacgcgtatccaacctgtcccgcgcgcggggacagcccttggaaatgaggattaacccccgataggccatggggccgcatggtttcatggtgaacctttgcgcgggttgggg

SEQ ID NO: 1790 - DNA, 225 bp, Unknown
  Encodes 16S rRNA from Mannheimia
agagtttgatcatggctcaggacgaacgctggcggcgtgcttaacacatgcaagtcgaacggggaatattgcacaatgggggaaaccctgatgcagccatgccgcgtgtgtgaagaaggccttcgggttgtaaagcacttttgcattcgaggaagacggcgtataaataaatgcgctatttgacgttagagtgtgaataagcaccggcaaactccgtgccagcag

SEQ ID NO: 1791 - DNA, 225 bp, Unknown
  Encodes 16S rRNA from Lactobacillus
agagtttgatcatggctcaggacgaacgctggcggcgtgcctaatacatgcaagtcgaacgagactttttatttgatgcttgcatcttttaaaaagttgagtggcgaacgggtgagtaacacgtgggtaacctgccttaaagtgggggataacacttggaaacaggtgctaataccgcataaccatcaaaaccgcctggttttgatgttaaagatggttctgcta

SEQ ID NO: 1792 - DNA, 225 bp, Unknown
  Encodes 16S rRNA from Clostridium IV
agagtttgatcctggctcaggagaaacgctggcggcgcacataagacatgcaagtcgaacggaacttagttgaatgtttacatgagacgaaagtttagtggcggacgggtgagtaacacgtgagcaacctgcctttaagagggggataacattgagaaatcagtgctaataccgcataaagcatagcattcgcatgtaagctatgccaaaggagaaatccgctta

SEQ ID NO: 1793 - DNA, 225 bp, Unknown
  Encodes 16S rRNA from Clostridium IV
agagtttgatcatggctcaggataaacgctggcggcgtgcataacacattcaagtcgaacggactgattggggagcttgctctccatgaaagttagtggcggacgggtgagtaacgcgtgagcaacctgcctttgcgagggggataacacagagaaatttgtgctaataccgcatgacgcaccgaggtcacatggccatggtgtcaaaggagcaatccgcgcaaa

SEQ ID NO: 1794 - DNA, 225 bp, Unknown
  Encodes 16S rRNA from Adlercreutzia
agagtttgatcctggctcaggatgaacgctggcggcgtgcctaacacatgcaagtcgaacggttaaaccggcttcggccggatatagagtggcgaacgggtgagtaacacgtgaccaacctgccccccgctccgggataacccagggaaacctgcgctaataccggacgatgccgcaagggcgcatgccctcgcggccgaagcccaggcggcgggggatggggtc

SEQ ID NO: 1795 - DNA, 225 bp, Unknown
  Encodes 16S rRNA from Selenomonas
agagtttgatcatggctcaggacgaacgctggcggcgtgcttaacacatgcaagtcgaacgggactgattgaaagcttgcttttgaaaagtctagtggcaaacgggtgagtaacgcgtaggcaacctgcctctaagatggggacaacagtccgaaaggactgctaataccgaatgttgtgagtttttcgcatgaaagactcattaaagatggcctctacttgtaa

SEQ ID NO: 1796 - DNA, 225 bp, Unknown
  Encodes 16S rRNA from Paenibacillus
agagtttgatcatggctcaggatgaacgctggcggcatgcctaagacatgcaagtcgtacgcgagggcccaatgaagacattgaaactgaagaagcttgcttctgatgtggatttgttggatttggattttccctcgagtggcaaacgggtgagtaacacgtgggttacctgcctctatgttggggataacagttggaaacgattgctaataccgaatatgctct

SEQ ID NO: 1797 - DNA, 225 bp, Unknown
  Encodes 16S rRNA from Clostridium IV
agagtttgatcctggctcaggacgaacgctggcggcgcgcctaacacatgcaagtcgaacggagagtgtgttttgaattcttcggaaggaaaggcacatttcttagtggcggacgggtgagtaacacgtgagcaacctgccttgtagagggggataacgattggaaacgatcgctaataccacatgatatatgggtatcgcatggtaaccatatcaaagatttat

SEQ ID NO: 1798 - DNA, 225 bp, Unknown
  Encodes 16S rRNA from Paenibacillus
agagtttgatcatggctcaggatgaacgctggcggcatgcctaagacatgcaagtcgaacgaggtggcccaatgaaggtggagtgcttgcacaatactggatttggattcccgcctagtggcagacgggtgagtaacacgtgggttacctacctctttgttggggataacagttggaaacgattgctaataccgaataagatactcgtattgaaaggagctttca

SEQ ID NO: 1799 - DNA, 225 bp, Unknown
  Encodes 16S rRNA from Butyricimonas
agagtttgatcctggctcaggatgaacgctagcggcaggcttaacacatgcaagtcgaggggcagcgcggggtagcaatactctggcggcgaccggcggaagggtgcgtaacgcgtgagcaacttgcccgtcactgggggataggcactggaaacggtgtgtaatactccataacatatggattcacatggatttatattgaaagattcgttggtgacggatggg

SEQ ID NO: 1800 - DNA, 225 bp, Unknown
  Encodes 16S rRNA from Wandonia
agagtttgatcatggctcaggatgaacgctagcggcaggcctaacacatgcaagtcgaggggcagcaggaggtagcaataccttgctggcgaccggcgcacgggtgcgtaacgcgtatgcaacctacccatgacagggggataacggagagaaatttccactaataccccgtattgttcaggaatcgcatggtttttggacgaaagcctttgggcggtcatggac

SEQ ID NO: 1801 - DNA, 225 bp, Unknown
  Encodes 16S rRNA from Puniceicoccus
agagtttgatcatggctcagagtgaacgctggcgacgtggctaagacatgcaagtcgagcgagaaggtgccttcgggtatcggaaagcggcaaacgggtgcgtaacacgtaagtaacctgcccttaagacgggaatagcttgatgaaaattgagataatgcccgatatcaaattcttccgcatggaagaagtttgaaaggtttgtgatgacgcttaaggagggac

SEQ ID NO: 1802 - DNA, 225 bp, Unknown
  Encodes 16S rRNA from Lactonifactor
agagtttgatcatggctcaggatgaacgctagctacaggcttaacacatgcaagtcgaggggcagcatcgggcagtgggggatattgcacaatgggcgcaagcctgatgcagcgacgccgcgtgaaggaagacgtatttcggtatgtaaacttctatcagcggggaagaagatgacggtacccgactaagaagccccggctaattacgtgccagcagccgcggta

SEQ ID NO: 1803 - DNA, 225 bp, Unknown
  Encodes 16S rRNA from Selenomonas
agagtttgatcatggctcaggacgaacgctggcggcgtgcttaacacatgcaagtcgaacgagacggattgaaagcttgcttttgaaatgtcgagtggcaaacgggtgagtaacgcgtagacaacctgccgcaaagatggggacaacagtccgaaaggactgctaataccgaatgttgtcaagtttccgcatgggagcttgattaaagatggcctctacttgtaa

SEQ ID NO: 1804 - DNA, 225 bp, Unknown
  Encodes 16S rRNA from Brevundimonas
agagtttgatcatggctcaggacgaacgctggcggtgtgcctcatacatgcaagtcgaacgataaggttccttcgggaatacataagtggcggacgggtgagtacaacataggaaatctgccctaaagcgggggacaacagagggaaactcctgctaataccccatatgagcttggttgaaataccaatcttgaaagatttatcactttaggatgagcctgtgcc

SEQ ID NO: 1805 - DNA, 225 bp, Unknown
  Encodes 16S rRNA from Prevotella
agatttgatcctggctcaggatgaacgctagctacaggcttaacacatgcaagtcgaggggcagcgggaagtttgcttgcaagcttcgccggcgaccggcgcacgggtgagtaacgcgtatccaacctgccccacggtcggggacagcccggcgaaagtcggattaacccccgatggtcccgcaagacggcatcagattgcgggtaaaggctcgtccgccgtggg

SEQ ID NO: 1806 - DNA, 225 bp, Unknown
  Encodes 16S rRNA from Gelidibacter
agagtttgatcctggctcaggataaacgctagcggcaggcctaacacatgcaagtcgagcggcaacgggagtagcaatacttgccggcgagcggcggacgggtgagtaacgcgtatgcaacctgcccatcacacggagatagccgaccgaaaggacgattaaactccgatggcatcaagagggggcatccccatttgattaaatattcataggtgatggatgggc

SEQ ID NO: 1807 - DNA, 225 bp, Unknown
  Encodes 16S rRNA from Mogibacterium
agagtttgatcctggctcaggatgaacgctggcggcgtgcctaatacatgcaagtcgagcgagaagctccattgaagcgttttcggacaattcaaaggagtggaaagcggcggacgggtgagtaacgcgtaggcaacctgcccttagcagagggatagccattggaaacgatgattaaaacctcataacgccaactcaacacatgttgagctggccaaagattta

SEQ ID NO: 1808 - DNA, 225 bp, Unknown
  Encodes 16S rRNA from Clostridium XlVa
agagtttgatcatggctcaggatgaacgctggcggcgtgcctaacacatgcaagtcgaacgaagttgtttccatccgacagaatatcttcggatatgaagtcaccggaaacgcttagtggcggacgggtgagtaacgcgtgggcaacctgccctacacagggggatagcggttggaaacgaccggtaataccgcatacctttattgaaccgcatgatttaataaa

SEQ ID NO: 1809 - DNA, 225 bp, Unknown
  Encodes 16S rRNA from Coprococcus
agagtttgatcatggctcagattgaacgctggcggcgtgcttaacacatgcaagtcgaacggactgatgagagagcttgctctttctgaaagttagtggcggacgggtgagtaacgcgtgggaaacctgccttacactgggggataacagatggaaacgcctgttaataccgcataagcgcacggtgctgcatggtaccgtgtgaaaaactctggtggtgtaaga

SEQ ID NO: 1810 - DNA, 225 bp, Unknown
  Encodes 16S rRNA from unknown taxa
agagtttgatcatggctcagaacgaacgctggcagcgtggattaggcatgcaagtcgaacgggatccggaaggtagcaatatcggccggtgagagtggcggaagggcgaggagcacgtggacaacctgtccagaggacggggaaaacctcgggaaactgaggctaatacccgatgcgccgggagctgggcatccatcttccggcaaagggggcgaaagctcccgc

SEQ ID NO: 1811 - DNA, 225 bp, Unknown
  Encodes 16S rRNA from Barnesiella
agagtttgatcatggctcaggatgaacgctagcgacaggcctaacacatgcaagtcgaggggcagcattatcgaagcttgctttgatagatggcgaccggcgcacgggtgagtaacgcgtatgcaacctgtccgtcatagtgggataatcccgagaaattgggtctaataccacgtatgccgtatatgggcatccatgtacggtgaaagagattcgttgacggtt

SEQ ID NO: 1812 - DNA, 225 bp, Unknown
  Encodes 16S rRNA from unknown taxa
agagtttgatcatggctcagaacgaacgctggcagcgtggatgaggcatgcaagtcgaacggtcgtgtgctggtagcaatattggtgcacgatagtggcggaagggcgagtaatgcgagagcaagctacccctcgattcggaacaacggctggaaacggccgctaatgccggatacgaacgcgaagccgcatggctttgcgttgaaaggccgggacccgcaaggg

SEQ ID NO: 1813 - DNA, 225 bp, Unknown
  Encodes 16S rRNA from Clostridium XlVa
agagtttgatcctggctcaggatgaacgctggcggcgtgcctaacacatgcaagtcgaacggagatgtgacaccggaagaggattcgtctgattccaccgttgcatcttagtggcggatgggtgagtaacgcgtggataacctgcccttcactgggggataacaaccggaaacgggtgctaataccgcataggcgcacggggccgcatggccttgagcgtaaaga

SEQ ID NO: 1814 - DNA, 225 bp, Unknown
  Encodes 16S rRNA from Anaerovorax
agagtttgatcatggctcaggatgaacgctggcggcgtgcttaacacatgcaagtcgagcgagaaacctaaaaatgacgcttcggtagattttttaggcggaaagcggcggacgggtgagtaacgcgtaggcaacctgcccttagcagagggatagcctcgggaaaccgggattaaaacctcataatactgtacattcacatgtatgtatagtcaaagatttatc

SEQ ID NO: 1815 - DNA, 225 bp, Unknown
  Encodes 16S rRNA from Bacteroides
agagtttgatcctggctcaggatgaacgctagcggcaggcttaacacatgcaagtcgaggggcagcgtgttggtagcaataccgacgacggcgaccggcgcacgggtgagtaacgcgtatgcaacctttcccagacagggggatagcccagggaaacttggattaataccccgtaggccacggatgggcatccgtctgtggttaaagttccggcggtctggggtg

SEQ ID NO: 1816 - DNA, 225 bp, Unknown
  Encodes 16S rRNA from Parasporobacterium
agagtttgatcatggctcaggatgaacgctggcggcacgcttaacacatgcaagtcgaacgaggttatggacttcggttaataacctagtggcggacgggtgcgtaacgcgtgggtaatctgcccttgacagggggataacgtatagaaatgtacgctaataccgcataagcccacgagaccgcatggtcttgagggaaaagggatactggtcaaggatgagccc

SEQ ID NO: 1817 - DNA, 225 bp, Unknown
  Encodes 16S rRNA from Prevotella
agagtttgatcatggctcaggatgaacgctagctacaggcttaacacatgcaagtcgcggggcagcatgaagccagcttgctggctttgatggcgaccggcgcacgggtgagtaacgcgtatccaacctgcccatgggcgaggcacagcccggcgaaagccggattaatgccttgcggtctccttgaaggccatccgccgaggagtaaaggcttttagccgccca

SEQ ID NO: 1818 - DNA, 225 bp, Unknown
  Encodes 16S rRNA from Parapedobacter
agagtttgatcctggctcaggatgaacgctagcggcaggcctaacacatgcaagtcgaggggcagcgcggtgtggcaacacactggcggcgaccggcggatgggtgcgtaacgcgtatgcaacctgcctccgagagggggataacccgtggaaacgcggactaataccccgtatgcgcacgacgccgcatgacgttgtgcggaaagattcattgctcggagatgg

SEQ ID NO: 1819 - DNA, 225 bp, Unknown
  Encodes 16S rRNA from Streptomyces
agagtttgatcatggctcaggacgaacgctggcggcgtgcttaacacatgcaagtcgaacggtgaaccagggcttgccctggggatcagtggcgaacgggtgagtaacacgtgggcaacctgccccagactctgggataactccgggaaaccggggctaataccggatacgacctccttgggcatcctcggaggtggaaagtttttcggtctgggatgggcccgc

SEQ ID NO: 1820 - DNA, 225 bp, Unknown
  Encodes 16S rRNA from unknown taxa
agagtttgatcctggctcaggatgaatgctggcggcgtgcctaacacatgcaagtcgagcggcagcgcgagtagtttactacttggcggcgagcggcggacggctgagtaacgcgtgggaatctgccctaaagtgagggataacgcaccgaaaggtgtgctaataccgcatatggtcttcggattaaagaatttattcgctttaggaggagcccgcgtcggatta

SEQ ID NO: 1821 - DNA, 225 bp, Unknown
  Encodes 16S rRNA from Thermotalea
agagtttgatcctggctcaggatgaacgctggcggcgtgcctaacacatgcaagtcgagcgagaaacctttcagaagattcttcggatgattcagagaggtggacagcggcggacgggtgagtaacgcgtgggcaacctgcccctatccggaggatagccaagggaaactttgaataatactccataaagcatggacatcacatggtgaccatgccaaagattta

SEQ ID NO: 1822 - DNA, 225 bp, Unknown
  Encodes 16S rRNA from Alkaliflexus
agagtttgatcctggctcaggatgaacgctagcggcaggcttaacacatgcaagtcgaggggcagcgcgggtagcaatacctggcggcgaccggcggaagggtgcgtaacgcgtgagcgacatacccgtgacagggggataacagatggaaacgtctcctaataccccataagatcatatatcgcatggtatgtgattgaaaggtgagaaccggtcacggattgg

SEQ ID NO: 1823 - DNA, 225 bp, Unknown
  Encodes 16S rRNA from Oscillibacter
agagtttgatcctggctcaggacgaacgctggcggcgtgcctaacacatgcaagtcgaacgagaatctatggacggaggcttcggccaactgaaatagaggaaagtggcgaacgggtgagtaacgcgtgagaaacctgccttggagtgggggacaacagttggaaacgactgctaataccgcataatatgcctgaggggcatccctccgggcatcaaagctttat

SEQ ID NO: 1824 - DNA, 225 bp, Unknown
  Encodes 16S rRNA from Anaerotruncus
agagtttgatcatggctcaggagaaacgctggcggcgcacataagacatgcaagtcgaacggaacttagtcgaatgttaaccaggagacgaaagtttagtggcggacgggtgagtaacacgtgagcaacctaccttagagagggggataacattgagaaatcagtgctaataccgcataaagctattagttcgcatggacaagatagccaaaggagaaatccgct

SEQ ID NO: 1825 - DNA, 225 bp, Unknown
  Encodes 16S rRNA from Spirochaeta
agagtttgatcatggctcagaacgaacgctggcggcgcgtcttaagcatgcaagtcgagcgggagtaagggagcttgcttccttatgagagcggcggactggtgagtaacacgtgggtaacgcaccctcctgacggggacagcctgtggaaacacagggtaataccggatgagatggacttctggaagggagttcatgaaaggagctacggctccgcagggggaa

SEQ ID NO: 1826 - DNA, 225 bp, Unknown
  Encodes 16S rRNA from Clostridium XI
agagtttgatcctggctcaggatgaacgctggcggcgtgcttaacacatgcaagtcgaacggagacatatgacggaagttttcggatggaagatatatgtcttagtggcggacgggtgagtaacacgtaaacaatctgcctttgagagcgggacaacagatagaaatatttgctaataccgcataagaccacaggttcgcatgaactaggggtaaaaggggagca

SEQ ID NO: 1827 - DNA, 225 bp, Unknown
  Encodes 16S rRNA from Sporotomaculum
agagtttgatcatggctcaggacgaacgctggcggcgtgcttaacacatgcaagtcgaacgaggaatgtttgaaagcttgcttttggacatttcgagtggcggacgggtgagtaacgcgtgaggaacctgtcttctacagggggataacgtcccgaaagggacgctaataccgcataagaccacagtgccgcatggcagaggggtcaaaggagagatccggtaga

SEQ ID NO: 1828 - DNA, 225 bp, Unknown
  Encodes 16S rRNA from Sporacetigenium
agagtttgatcctggctcaggacgaacgctggcggcgtgcctaacacatgcaagtcgagcgaggggaggggcttcggccccgaaccgagcggcggacgggtgagtaacgcgtgaatgatctgtcccttacaggggaataacacttggaaacaggtgctaataccgcataagaccacggtgctgcatggcactgaggtaaaaggagcgatccggtgaggggtgagt

SEQ ID NO: 1829 - DNA, 225 bp, Unknown
  Encodes 16S rRNA from Bulleidia
agagtttgatcatggctcaggataaacgctggcggcgtgcctaatacatgcaagtcgaacgaagggaaccagtttactggtgaacttagtggcgaacgggtgagtaatacgtaagcaacctgcccacggagaccgggataatccctggaaacggggactaagaccggataggcagcggaggggcatcccactgctgttaaagatggaaaacactggtggatgggc

SEQ ID NO: 1830 - DNA, 225 bp, Unknown
  Encodes 16S rRNA from Clostridium IV
agagtttgatcctggctcaggacgaacgctggcggcacgcttaacacatgcaagtcgaacggagttttgagagcttgctcttaaaacttagtggcggacgggtgagtaacacgtgagcaacctgccttcgggtgtggaataatggctggaaacgaccactaataccgcataacacgatcggaccgcatgatctgatcgtcaaaggtttaccgcctgaagatgggc

SEQ ID NO: 1831 - DNA, 225 bp, Unknown
  Encodes 16S rRNA from Syntrophomonas
agagtttgatcatggctcaggacgaacgctggcggcgtgcctaacacatgcaagtcgaacgggaattaaacgagaatttcggttcatgtttaattttagtggcggacgggtgagtaacgcgtgagaatctgcctttaagtggggaataacagttggaaacgactgctaataccgcataacatgggaaaccatcaaagggggtgcaagccctcgcttagagatgag

SEQ ID NO: 1832 - DNA, 225 bp, Unknown
  Encodes 16S rRNA from Desulfatiferula
agagtttgatcctggctcaggatgaacgctggcggcgtgcatcatacatgcaagtcgaacgagaatctatagcttgctatagaggaaagtggcggacgggtgagtaaaatatagggaatctgcccgtaagagggggacaacaaggggaaacctttgctaataccgcatatgagatattctgaaatggatatcttgaaagaatttatcgcttacggatgagcctgt

SEQ ID NO: 1833 - DNA, 225 bp, Unknown
  Encodes 16S rRNA from Hydrogenoanaerobacterium
agagtttgatcatggctcaggacgaacgctggcggcgcgcctaacacatgcaagtcgaacggagaaagttcttcggagctttcttagtggcgaacgggtgagtaacacgtgagcaacctgcctttctgagggggataacgtttggaaacgaacgctaataccgcatgacaccgtagagtcacatggctcagcggtcaaaggagtaatccgcagaaagatgggctc

SEQ ID NO: 1834 - DNA, 225 bp, Unknown
  Encodes 16S rRNA from Clostridium XlVa
agagtttgatcctggctcaggatgaacgctggcggcgtgcctaacacatgcaagtcgaacggaactttaatgaagcctagcgatttaaagtttagtggcggacgggtgagtaacgcgtgggtaacctgccgtatgcagggggacaacagttggaaacgactgctaataccgcataagcgcacagcttcgcatggagcagtgtgaaaagatttatcggcatacgat

SEQ ID NO: 1835 - DNA, 225 bp, Unknown
  Encodes 16S rRNA from Mogibacterium
agagtttgatcctggctcaggatgaacgctggcggcgtgcctaatacatgcaagtcgagcgagaaattgatcagacgcgttttcggacaagtcaggtcaatggaaagcggcggacgggtgagtaacgcgtaggcaacctgcccttagcagagggatagccattggaaacgatgattaaaacctcataatgccggaggagcacatgctccatcggccaaagattta

SEQ ID NO: 1836 - DNA, 225 bp, Unknown
  Encodes 16S rRNA from Spirochaeta
agagtttgatcatggctcagaacgaacgctggcggcgcgtcttaagcatgcaagtcgagcggtaagattggtgcttgcaccgatcctagagcggcggactggtgagtaacgcgtgggtgacctaccccgtggatgggaatagccggtagaaataccgggtaatgccgaatacggtccctgacgtcagaggtcagggaggaaaggagctccggctccgccacggga

SEQ ID NO: 1837 - DNA, 225 bp, Unknown
  Encodes 16S rRNA from Prevotella
agagtttgatcctggctcaggatgaacgctagctacaggcttaacacatgcaagtcgaggggcagcatgtcgtgtgcttgcacgcgatgatggcgaccggcgcacgggtgagtaacgcgtatccaacctgcccatgaccccgggatagcccgctgaaaagcggattaacaccggatgcggtcgaaagaggacatctgatttcgaccaaagcttcggcggtcatgg

SEQ ID NO: 1838 - DNA, 225 bp, Unknown
  Encodes 16S rRNA from Treponema
agagtttgatcctggctcagaacgaacgctggcggcgcgtcttaagcatgcaagtcgagcgggattcggtagcttgctaccgatgagagcggcggactggtgagtaacacgtaggtgacgtaccttgaggacggggacagccggcagaaatgccgggtaataccggataagctcgcgcgagccggaatcgcgcgaggaaaggagctaaggctccgcctccagagc

SEQ ID NO: 1839 - DNA, 225 bp, Unknown
  Encodes 16S rRNA from Spiroplasma
agagtttgatcatggctcaggatgaacgctggcggcatgcctaagacatgcaagtcgaacgaagtggcccaacaaaaactgcgtacttgtacaaagttggcgatggaatttccacttagtggcagacgggtgagtaatacataagtaatctgccctcaagactggaataatgtctggaaacggacactaataccggataattcatttatagataactatttatgc

SEQ ID NO: 1840 - DNA, 225 bp, Unknown
  Encodes 16S rRNA from Clostridium XlVa
agagtttgatcctggctcaggatgaacgctggcggcgtgcctaacacatgcaagtcgagcggagtaagccaccggatgaagattcgtcggattccaccggtttacttagcggcggatgggtgagtaacgcgtggacaacctgcccttcactgggggataacaaccggaaacgggtgctaataccgcatgggcgcgacgggccgcatgacctgtagcgtaaagatt

SEQ ID NO: 1841 - DNA, 225 bp, Unknown; identical to SEQ ID NO: 1526
  Encodes 16S rRNA from Bacteroides

SEQ ID NO: 1842 - DNA, 225 bp, Unknown
  Encodes 16S rRNA from Treponema
agagtttgatcatggctcagaacgaacgctggcggcgcgtcttaagcatgcaagtcgagcgggaatgtggtgcttgcaccacaggagagcggcggactggtgagtaacgcgtggatgacgcacccccctgacggggacagcctgcagaaatgcagggtgataccggatacgatcttgggtattggaagcccgagaggaaagcacctgcgggtgcgcagggggagc

SEQ ID NO: 1843 - DNA, 225 bp, Unknown
  Encodes 16S rRNA from Selenomonas
agagtttgatcctggctcaggacgaacgctggcggcgtgcttaacacatgcaagtcgaacggggcaattgaaagcttgcttttgagagcctagtggcaaacgggtgagtaacgcgtaggcaacctgccttcgggatggggacaacaggacgaaagccctgctaataccgaatgaagcatccttcctgcatgggaagggtatgaaagatggcctctgaatatgcta

SEQ ID NO: 1844 - DNA, 225 bp, Unknown
  Encodes 16S rRNA from Butyricicoccus
agagtttgatcctggctcaggacgaacgctggcggcgtgcctaacacatgcaagtcgaacggggtaccctctacggaagcttcggccgaagaagaggactacctagtggcggacgggtgagtaacgcgtgagcaacctgcctttaagagggggataacataccgaaaggtatgctaataccgcataagatattagtaccgcatgatacagatatcaaagatttca

SEQ ID NO: 1845 - DNA, 225 bp, Unknown
  Encodes 16S rRNA from Gelidibacter
agagtttgatcatggctcaggataaacgctagcggcaggcctaacacatgcaagtcgagcggcagcacggtgtagcaatacattggtggcgagcggcggacgggtgagtaacgcgtatgcaacctacctgtaacacggggatagccaaccgaaaggatgattaacacccgatagtacttttaaactgcatggtttaaaagttaaatatttataggttacagatgg

SEQ ID NO: 1846 - DNA, 225 bp, Unknown
  Encodes 16S rRNA from Acetitomaculum
agagtttgatcctggctcaggatgaacgctggcggcgtgcctaacacatgcaagtcgaacggagccggatggaaggagccttcgggtgacagaaatccatgcttagtggcggacgggtgagtaacgcgtgggcaacctgccctgtggagggggatacctgttggaaacggcagttaataccccatgagcgcacgcctgtgcatgcaggcgtgtgaaaaggagcaa

SEQ ID NO: 1847 - DNA, 225 bp, Unknown
  Encodes 16S rRNA from Proteiniclasticum
agagtttgatcatggctcaggacgaacgctggcggcgtgcttaacacatgcaagtcgagcggggataatgagacggaaggcttcggccggaagacttattattctagcggcggacgggtgagtaacgcgtgaatgatctgtctcttacagggggataacacttggaaacaggtgctaataccgcataagaccacggggctgcatggctttggggtaaaaggagca

SEQ ID NO: 1848 - DNA, 225 bp, Unknown
  Encodes 16S rRNA from Papillibacter
agagtttgatcatggctcaggatgaacgctggcggcgtgcataacacattcaagtcgaacgaagcactgtcgaggaagtcttcggacggaattgactttgacttagtggcggacgggtgagtaacgcgtgagcaaccttcctgcctgtgagggataacacagggaaacttgtgctaataccgcatgaagcatgattatcgcatggtagacatgccaaagattaat

SEQ ID NO: 1849 - DNA, 225 bp, Unknown
  Encodes 16S rRNA from Prevotella
agagtttgatcctggctcaggatgaacgctagcggcaggcttaacacatgcaagtcgaggggcagcgcggtagtagcaatactactggcggcgaccggcgaaagggtgcgtaacgcgtgagcgacatgcccgcgaccgggggataacagatggaaacgtctactaataccccataacaacagggttcgcatggatcttgtttgaaagatttatcgtttgcggatt

SEQ ID NO: 1850 - DNA, 225 bp, Unknown
  Encodes 16S rRNA from Elusimicrobium
agagtttgatcctggctcagagttaacgctggcagcgtgcataacacatgcaagtcgaacggggattattcgatgtagcaatacattggataattctagtggcagacgagtgagtaatacataagaaatctacccgaaagtggggaataacgggccgaaaggttcgctaataccccataatatttgaaagcggcatcgctttcttcttaaaggtttttcgctttc

SEQ ID NO: 1851 - DNA, 225 bp, Unknown
  Encodes 16S rRNA from Lachnospiracea incertae sedis
agagtttgatcatggctcaggatgaacgctggcggcgcgcttaacacatgcaagtcgaacggaatttatagcttcggttgtaaattcagtggcggacgggtgagtaacgcgtggataacttgccttttagtgggggatagctgagagaaatctcaattaataccgcataaagtaatttattcgcatgaatagattaataaagatgaaaatcgctaaaagataggt

SEQ ID NO: 1852 - DNA, 225 bp, Unknown
  Encodes 16S rRNA from Devosia
agagtttgatcatggctcagaacgaacgctgtcgacatgcttaacacatgcaagtcggacgggtataacttgttataccagtggcaaacgggtgagtaatacgtagaaatgtacccagtagttccgaataacaactggaaacggttggtaatacgggataagatagagatatgaaagatctgaaaggatcgctattggagcagtctacgatggattagatagttg

SEQ ID NO: 1853 - DNA, 225 bp, Unknown
  Encodes 16S rRNA from Roseburia
agagtttgatcctggctcaggatgaacgctggcggcgtgcctaacacatgcaagtcgagcggacctgacggagtgaatagcttgctaggaactccagactggttagcggcggacgggtgagtaacgcgtgggtaacctgcctcatacagggggatagcagttggaaacgactggtaataccgcataagcgcacagtaccgcatggtacggtgtgaaaaactccgg

SEQ ID NO: 1854 - DNA, 225 bp, Unknown
  Encodes 16S rRNA from Mucilaginibacter
agagtttgatcatggctcaggatgaacgctagcggcaggcctaatacatgcaagtcggacgggaactccccttcgggggagcgagagtggcgcacgggtgcgtaacgcgtatgcaaccaaccccgcactgggggacagccggtggaaacgccgggtaataccccatgccgaccctgtggggcatcccatggggtcgaaagcagcgatgcggtgcgggacgggcat

SEQ ID NO: 1855 - DNA, 225 bp, Unknown
  Encodes 16S rRNA from Mogibacterium
agagtttgatcatggctcaggatgaacgctggcggcgtgcctaatacatgcaagtcgagcgagaatcttcagaaacaattcttcggatgcgtttcaggagaggaaagcggcggacgggtgagtaacgcgtaggcaacctgcccctggcagagggatagccattggaaacgatgattaaaacctcataacgcttcaagagcacatgctgttgaagccaaagattta

SEQ ID NO: 1856 - DNA, 225 bp, Unknown
  Encodes 16S rRNA from Saccharofermentans
agagtttgatcctggctcaggacgaacgctggcggcgtgcctaacacatgcaagtcgagcggagatattttccggaaagcttcggccggaaggggaatattttagcggcggacgggtgagtaacgcgtgagcaacctttccttcacagggggataaagcaccgaaaggtgccctaataccgcatgagaccacggcatcacatgaagcaggggtcaaaggagcaat

SEQ ID NO: 1857 - DNA, 225 bp, Unknown
  Encodes 16S rRNA from Paenibacillus
agagtttgatcatggctcaggattaacgctggcggcatgcctaagacatgcaagtcgaacgagagggcccattgacatttatcgaaagttgaagtgcttgcactgatgctggacttatttagatttggattttccctctagtggcaaacgggtgagtaacacgtgggttacctgcctcttagactgggataccgattggaaacgatcgttaataccggatgttct

SEQ ID NO: 1858 - DNA, 225 bp, Unknown
  Encodes 16S rRNA from Anaerotruncus
agagtttgatcatggctcaggacgaacgctggcggcgcgcttaacacatgcaagtcgaacggagttgatttttaacacccgagtctgcgaggcaggagctttgcagattgggggttaagaatcaacttagtggcggacgggtgagtaacacgtgagcaacctgcctttcagagggggataacgtctggaaacggacgctaataccgcatgaagtatatttttcgc

SEQ ID NO: 1859 - DNA, 225 bp, Unknown
  Encodes 16S rRNA from Leucobacter
agagtttgatcctggctcaggacgaacgctggcggcgtgcttaacacatgcaagtcgaacgctgaagcccggagcttgctctgggtggatgagtggcgaacgggtgagtaacacgtgagtaacctgcccctcactctgggataagcgctggaaacggcgtctaatactggatatgacccataccggcatcggtagtgggtggaaagatttatcggtgggggatgg

SEQ ID NO: 1860 - DNA, 225 bp, Unknown
  Encodes 16S rRNA from Clostridium XlVa
agagtttgatcatggctcaggatgaacgctggcggcgtgcctaacacatgcaagtcgagcggagaggctgcggagattcaatagatgatctgcatcttcttagcggcggatgggtgagtaacacgtgggtaacctgccctgcactggggaataacagttggaaacgactgttaataccgcatatgcgcacggggtcgcatgaccccgggcggaaagatttatcgg

SEQ ID NO: 1861 - DNA, 225 bp, Unknown
  Encodes 16S rRNA from Eubacterium
agagtttgatcatggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggctgggtcttgaaagtcaaggcggtgacggattgg

SEQ ID NO: 1862 - DNA, 225 bp, Unknown
  Encodes 16S rRNA from Beijerinckia
agagtttgatcctggctcagaacgaacgctggcggcaggcttaacacatgcaagtcgaacggaacatagggagcttgctccttatgtcagtggcgcacgggtgagtaacgcgtaggaatctgtccttttgcctgggatagcctctggaaacggagggtaaaaccggatgagccctaagggggaaatgagcaatcagctggaggaggagcctgcgttagattaggc

SEQ ID NO: 1863 - DNA, 225 bp, Unknown
  Encodes 16S rRNA from Prevotella
agagtttgatcctggctcaggatgaacgctagctacaggcttaacacatgcaagtcgaggggcagcgggagagtagcttgctactcttgccggcgaccggcgcacgggtgagtaacacgtatccaacctgccctgaaccccgggatagccctctgaaaggaggattaataccggatgtggccgctgggggacatcccccggcgtctaaagattcatcggttgagg

SEQ ID NO: 1864 - DNA, 225 bp, Unknown
  Encodes 16S rRNA from Clostridium III
agagtttgatcatggctcaggacgaacgctggcggcgtgcctaacacatgcaagtcgagcggaggaaatcgaaagaagccttcgggtgaattttggtggacttagcggcggacgggtgagtaacgcgtgagtaacctgcccataagagggggataatccttggaaacggggactaataccgcatatagagtatttgttgcatgattgatacttgaaagatttatc

SEQ ID NO: 1865 - DNA, 225 bp, Unknown
  Encodes 16S rRNA from unknown taxa
agagtttgatcctggctcaggacgaacgctggcggcgtgcttcatacatgcaagtcgaacgagaaattaccttcgggtaatggacagtggcggacgggtgagtaatgtgtagagaatctgccctttagtgggggatagcagttggaaacgactattaataccccatatgcgcgtagttgggatactattcgtgaaagattaatcgctaaaggatgagtctgcatc

SEQ ID NO: 1866 - DNA, 225 bp, Unknown
  Encodes 16S rRNA from Pseudoflavonifractor
agagtttgatcctggctcaggacgaacgctggcggcgtgcttaacacatgcaagtcgaacgagggtattagtcagcttgctgattgatacccgagtggcggacgggtgagtaacgcgtgaggaacctgtcttcatcagggggataacttcccgaaagggatgctaataccgcataagaccacgataccgcatggtattgaggtcaaaggagcaatccggatgaag

SEQ ID NO: 1867 - DNA, 225 bp, Unknown
  Encodes 16S rRNA from Butyrivibrio
agatttgatcatggctcaggatgaacgctggcggcgtgcctaacacatgcaagtcgaacggacgctttgaggagagtcttcggatgattcttaaagttgttagtggcggacgggtgagtaacgcgtggggaacctgcctttgtccgggggatagcagctggaaacggctggtaataccgcataagaccacgaagccgcatggctttgcggtaaaagatttatcgg

SEQ ID NO: 1868 - DNA, 225 bp, Unknown
  Encodes 16S rRNA from Acholeplasma
agagtttgatcctggctcaggatgaacgctggcggcgtgcctaatacatgcaagtcgaacggatcacttcggtgatcagtggcgaacgggtgagtaacacataaacaatctaccctgaagactgggataacggttggaaacgaccgctaataccggataggtgatcataaggcatcttgagatcattaaagttgggctgcaacactgcaggatgagtttatgtcg

SEQ ID NO: 1869 - DNA, 225 bp, Unknown
  Encodes 16S rRNA from Filomicrobium
agagtttgatcctggctcagaacgaacgctggcggcaggccttagatatgcaagttgaacggtctaaggtggagcttgctctactttagatagtagcggacgggtgagtaatacatgggaacgtaccctcttgtggggaatagcttttggaaacgaaaggtaataccgcataagccctacgggggaaaggagtaattcgcgagaggatcggcccatgccagatta

SEQ ID NO: 1870 - DNA, 225 bp, Unknown
  Encodes 16S rRNA from Clostridium III
agagtttgatcctggctcaggacgaacgctggcggcgtgcctaacacatgcaagtcgaacgagaagtgatgaaaagattccttcgggatgattagattcatggacagtggcggacgggcgagtaacgcgtgagtaacctgcccataagcgggggatagccgatggaaacgtcgagtaataccccatgacgtatatatatcgcatggtatatatatcaaagattta

SEQ ID NO: 1871 - DNA, 225 bp, Unknown
  Encodes 16S rRNA from Pseudoflavonifractor
agagtttgatcatggctcaggatgaacgctggcggcgtgcataacacattcaagtcgaacgaagcactttggacggatcccttcggggtgaagactgatttgacttagtggcggacgggtgagtaacgcgtgagcaacctgccttgaagagggggataacacagggaaacttgtgctaataccgcataacatacgtgaatcgcatggttcgtgtatcaaagctcc

SEQ ID NO: 1872 - DNA, 225 bp, Unknown
  Encodes 16S rRNA from Anaerophaga
agagtttgatcatggctcaggatgaacgctagcgacaggcttaacacatgcaagtcgaggggcagcgagtggcgttgttcgcaacgccatgtcggcgaccggcgcactggtgagtaacacgtatgcaacctgccctttaccggggcataacccttggaaacgaggcctaattccccatatacagcgcttgggcatccgggtgctgtgaaaggtttattccggtga

SEQ ID NO: 1873 - DNA, 225 bp, Unknown
  Encodes 16S rRNA from Lachnospiracea incertae sedis
agagtttgatcctggctcaggatgaacgctggcggcgtgcctaacacatgcaagtcgaacgaagctcctttgcggatctcttcggagtgaaggaaaggatgactgagtggcggacgggtgagtaacgcgtgggtaatctgccctgtacagggggacaacagttagaaatgactgctaataccgcatgagcgtacagcatcgcatgatgcagtgcgaaaaactgag

SEQ ID NO: 1874 - DNA, 225 bp, Unknown
  Encodes 16S rRNA from Asaccharobacter
agagtttgatcctggctcaggatgaacgctggcggcgtgcttaacacatgcaagtcgaacggttaagccgacttcggtcgggaatacagtggcgaacgggtgagtaacacgtgaccaacctgccccccgcaccgggacaacctccggaaacggaggctaataccggatatgcccgggcgcccgcatgggcggccggggaaagcccaggcggcgggggatggggtc

SEQ ID NO: 1875 - DNA, 225 bp, Unknown
  Encodes 16S rRNA from Kordia
agagtttgatcatggctcaggataaacgctagcggcaggcctaacacatgcaagtcgagcggcagcgtggatagcaatatctgacggcgagcggcggacgggtgagtaacgcgtatgcaacctacccactacacaaggatagccttccgaaaggaggattaatacttgatagtactctaagatggcatcaaaacagagttaaagatttatcggtagtggatgggc

SEQ ID NO: 1876 - DNA, 225 bp, Unknown
  Encodes 16S rRNA from Ruminococcus
agatttgatcatggctcaggacgaacgctggcggcacgcttaacacatgcaagtcgaacgggactaagagagaagcttgcttcacttttagtttagtggcggacgggtgagtaacacgtgagtaacctgcccttatcaggggaatagcctccggaaacggagagtaataccgcataagatgacagtacggcatcgtacagtcataaaagattttatcggataagg

SEQ ID NO: 1877 - DNA, 225 bp, Unknown
  Encodes 16S rRNA from Clostridium III
agagtttgatcctggctcaggacgaacgctggcggcgtgcctaacacatgcaagtcgaacgagaaatgatgatttgattccttcgggatgaaaagaatcatggacagtggcggacgggcgagtaacgcgtgagtaacctgcccataagagagggatagccgatggaaacgtcgagtaatacctcatattgtaattaattcgcatggattgattatgaaagattta

SEQ ID NO: 1878 - DNA, 225 bp, Unknown
  Encodes 16S rRNA from Ethanoligenens
agagtttgatcatggctcaggataaacgctggcggcgtgcataacacattcaagtcgaacggaactgtacggattaatccttcgggaagcgtttgtacagtttagtggcggacgggtgagtaacgcgtgagcaacctgcctacgagaggggaataacgtctggaaacggacgctaataccgcataaaccgcggggttcgcatggactccggggcaaagatttatc

SEQ ID NO: 1879 - DNA, 225 bp, Unknown
  Encodes 16S rRNA from Clostridium XlVa
agagtttgatcctggctcaggatgaacgctggcggcgtgcctaacacatgcaagtcgaacggagatgtccaatgggctgcttcggcagtccgggcatcttagtggcggacgggtgagtaacgcgtggagaacctggcccatgcagggggataacagcgggaaaccgctgctaataccgcataagcgccgaggggggcatcccttttggtggaaagcgtaagcggc

SEQ ID NO: 1880 - DNA, 225 bp, Unknown
  Encodes 16S rRNA from Barnesiella
agagtttgatcatggctcaggatgaacgctagcgacaggcctaacacatgcaagtcgaggggcagcacggtgtagcaatacactggtggcgaccggcgcacgggtgcgtaacaggtatgcaatctgtcccataccggggcatagcccgctgaaaggcggattaattctccatgtgtcatgagagggcatccttttatgatgaaacgtaagggtatgggatgagca

SEQ ID NO: 1881 - DNA, 225 bp, Unknown
  Encodes 16S rRNA from Eubacterium
agagtttgatcatggctcaggatgaacgctggcggcgtgcctaacacatgcaagtcgagcgagaatcttcggaaggaatcttcggaggacggaaggagaggaaagcggcggacgggtgagtaacgcgtaggtaacctgccctgtacagagggatagccactggaaacggtgattaataccttataaaactgagtattcacatggagattcagtcaaagatttatc

SEQ ID NO: 1882 - DNA, 225 bp, Unknown
  Encodes 16S rRNA from Prevotella
agagtttgatcctggctcaggatgaacgctagctacaggcttaacacatgcaagtcgaggggcagcatggaggttgcttgcaacttctgatggcgaccggcgcacgggtgagtaacgcgtatccgaccttcccccaggtagggaacagcccggcgaaagtcggattaatgccctatagtctgcgaattgcgcatgttgtttgcagtaaagattgatcgccttggg

SEQ ID NO: 1883 - DNA, 225 bp, Unknown
  Encodes 16S rRNA from Anaerophaga
agagtttgatcatggctcaggatgaacgctggcggcgtgcttaacacatgcaagtcgaggggcagcatgggaggtggcaacaccacccgatggcgaccggcgcactggtgagtaacacgtatgcaacctgccccctacagggggataatccagagaaatttggtctaataccccgtagtcagcgagagggcatcctcttgctgggagagctccggcggtagggga

SEQ ID NO: 1884 - DNA, 225 bp, Unknown
  Encodes 16S rRNA from Acetitomaculum
agagtttgatcctggctcaggatgaacgctggcggcgtgcctaacacatgcaagtcgaacggggatgcctcgccgttgaagcttcggcagagacatgagacatcctagtggcggacgggtgagtaacgcgtgggcaacctgccctgtactgggggatagcagctggaaacggctggtaataccgcataagcgcgcggcatcgcatggtgctgcgtgaaaagccga

SEQ ID NO: 1885 - DNA, 225 bp, Unknown
  Encodes 16S rRNA from Prevotella
agagtttgatcctggctcaggatgaacgctggcggcgtgcctaacacatgcaagtcgaggggcagcatgaaggttgcttgcaacctttgatggcgaccggcggatgggtgcgtaacgcgtatccaacctgcctgtgtcccgggcatagcccgtggaaacgcggattaactcccgatggtgcagcggtgccgcatggcgttgctgccaaatgtaaaggacacagat

SEQ ID NO: 1886 - DNA, 225 bp, Unknown
  Encodes 16S rRNA from Clostridium III
agagtttgatcctggctcaggacgaacgctggcggcgtgcctaacacatgcaagtcgaacgagaaatgatgatttgattctttcgggatgaaatgattcatggacagtggcggacgggcgagtaacgcgtgagtaacctgcccataagagagggatagccgatggaaacgtcgagtaataccacatattgtagtaagatcgcatggttttgctatgaaagattta

SEQ ID NO: 1887 - DNA, 225 bp, Unknown
  Encodes 16S rRNA from Marinoscillum
agagtttgatcatggctcaggatgaacgctggcggcaggcttaatacatgcaagtcgaacggtaaggcctgatgtagcaatacagagggtacacgagtggcgcacgggtgcgtaacgcgtatgtaatctgcctgcaaccgggacaaaacagttggaaacggctgctaatatcccatggtcaatttttcaggcatctgggagattgtaaagatttattggttgcag

SEQ ID NO: 1888 - DNA, 225 bp, Unknown
  Encodes 16S rRNA from Pedobacter
agagtttgatcctggctcaggatgaacgctagcggcaggcctaatacatgcaagtcgaacggtaaagtccccttcgggggattgagagtggcggacgggtgcgtaacgcgtatgcaaccaacccccctcaccgggatagccggtggaaacgccggataagaccggatgcgccggcggggaggcatctccctgtcggcaaggcggcgacgcggagggggacgggca

SEQ ID NO: 1889 - DNA, 225 bp, Unknown
  Encodes 16S rRNA from Prevotella
agagtttgatcctggctcaggatgaacgctagctacaggcttaacacatgcaagtcgaggggcagcatgaatcaagcttgcttgatttgatggcgaccggcgcacgggtgcgtaacgcgtatccaacctacccgtcactcagggatagccttgcgaaagtaagattaatacctgatggtctccttccggggcatcccggttggagtaaagattcatcggtggcgg

SEQ ID NO: 1890 - DNA, 225 bp, Unknown
  Encodes 16S rRNA from Prevotella
agagtttgatcatggctcaggatgaacgctagctacaggcttaacacatgcaagtcgaggggcatcatgggggttgtttacaatccctgatggcgaccggcgcacgggtgagtaacgcgtatccaacctgccttcgagtcagggataaccttccgaaagggagcctaatacctgatgcagtgcgaagatggcatcagatttgcactaaagcttttgcgctcgggg

SEQ ID NO: 1891 - DNA, 225 bp, Unknown
  Encodes 16S rRNA from Anaerovorax
agagtttgatcctggctcaggatgaacgctggcggcgtgcctaacacatgcaagtcgagcgagaagcttttcagtcgattcttcggaaaagacagagaagtggaaagcggcggacgggtgagtaacgcgtaggcaacctgccccttgcagagggatagcctcgggaaaccgggattaaaacctcataatgcatccacatgacatcttgaggatgccaaagattta

SEQ ID NO: 1892 - DNA, 225 bp, Unknown
  Encodes 16S rRNA from Clostridium XlVa
agagtttgatcatggctcaggatgaacgctggcggcgtgcttaatacatgcaagtcgaacgaagcgccctgtacagatttcttcggaatgaagttttgggtgacttagtggcggacgggtgagtaacgcgtgggtaacctgcctcatgcagggggacaacagctggaaacggctgctaataccgcataagcgcacgagatcgcatgatcaagtgtgaaaagattt

SEQ ID NO: 1893 - DNA, 225 bp, Unknown
  Encodes 16S rRNA from Clostridium IV
agagtttgatcctggctcaggatgaacgctggcggcgtgcataacacattcaagtcgaacgaagcactggcgaggaagtcttcggatggaattgcctttgacttagtggcggacgggtgagtaacgcgtgagcaaccttcctggtagtgagggataacacagggaaacttgtgctaataccgcatgacgcactgaggtcgcatggttttagtgccaaagatttat

SEQ ID NO: 1894 - DNA, 225 bp, Unknown
  Encodes 16S rRNA from Lachnospiracea incertae sedis
agagtttgatcctggctcaggatgaacgctggcggcgcgcttaacacatgcaagtcgaacggaatgattggcttcggtcatgaattcagtggcgaacgggtgagtaacacgtggataacttgccttttagtgggggatagctgagagaaatctcaattaataccgcataatgtaatctattcgcatgaatagattaataaagatgaaaatcgctaaaagataggt

SEQ ID NO: 1895 - DNA, 225 bp, Unknown
  Encodes 16S rRNA from Clostridium sensu stricto
agagtttgatcctggctcaggacgaacgctggcggcatgcctaacacatgcaagtcgaacgggataagtttggttgtagcgatacttttgaacttattcagtggcgaacgggtgagtaacacgtgagcaacctgccttttacacagggataacagttggaaacgactgctaataccggataagaccacactgaggcatctcagaggggtcaaagcgattcagcgg

SEQ ID NO: 1896 - DNA, 225 bp, Unknown
  Encodes 16S rRNA from Lishizhenia
agagtttgatcctggctcaggatgaacgctagcggcaggcctaacacatgcaagtcgaggggcagcgcgaggtagcaataccttggcggcgaccggcggacgggtgcgtaacgcgtatggaaccaacccgtcacagggggacaagccagggaaacttggtctaataccccatactactgttaaatcgcatggtatgacagtgaaagcttacgggcggtgacggac

SEQ ID NO: 1897 - DNA, 225 bp, Unknown
  Encodes 16S rRNA from Pedobacter
agagtttgatcctggctcaggatgaacgctagcggcaggcctaatacatgcaagtcgtacgggatctccccttcgggggagtgagagtggcgcacgggtgcgtaacgcgtatgcaaccaaccctcatccgggggacagccggtggaaacgccgggtaataccccatatccactttgggaggcatcttctgaggtggaaaggctttggtcggaggaggacgggcat

SEQ ID NO: 1898 - DNA, 225 bp, Unknown
  Encodes 16S rRNA from Howardella
agagtttgatcatggctcaggagaaacgctggcggcgcacataagacatgcaagtcgaacggaacttagattgatgtttacattgaactaagtttagtggcggactggtgagtaacacgtgagcaacctgccctttagagggggataacattgagaaatcagtgctaataccgcataacgcaattcttccgcatgaaagaattgccaaaggagaaatccgcttaa

SEQ ID NO: 1899 - DNA, 225 bp, Unknown
  Encodes 16S rRNA from Roseburia
agagtttgatcctggctcaggatgaacgctggcggcgtgcttaacacatgcaagtcgaacggactttactgaaaagagggcttgcccaatggaaggtaaagttagtggcggacgggtgagtaacgcgtgggcaacctgccttacacagggggacaacagttggaaacgactgctaataccgcataagccggtagtgccgcatggcacatccggaaaagattgtat

SEQ ID NO: 1900 - DNA, 225 bp, Unknown
  Encodes 16S rRNA from Clostridium XlVa
agagtttgatcatggctcaggatgaacgctggcggcgtgcttaatacatgcaagtcgaacggggatgtccacccgatgaagccagagtgcttgcacaaaggccgattcaaccgggcatcctagtggcggacgggtgagtaacgcgtgggtaacctgcctcatactggggaataacagtcagaaatgactgctaataccgcataagcgcacagtgccgcatggcac

SEQ ID NO: 1901 - DNA, 225 bp, Unknown
  Encodes 16S rRNA from Anaerovorax
agagtttgatcatggctcaggatgaacgctggcggcgtgcctaacacatgcaagtcgagcgggaaatattgaaatgaaacttcggtagattttcgatatggagagcggcggacgggtgagtaacgcgtaggcaacctgcccctggcagagggatagccactggaaacggtgattaaaacctcataacgcgcagatgctgcatagcaactgcgccaaagatttatc

SEQ ID NO: 1902 - DNA, 225 bp, Unknown
  Encodes 16S rRNA from Lentisphaera
agagtttgatcatggctcagaatgaacgctggcggcatggattaggcatgcaagtcgaacggcagggcagcgatgcccgagagtggcgaaagggtgagcaacgcgtggggaacctgcccccgggaccggaacaagcctgtgaaaacgggtctgaaaccggatgaagccccgcaccgcatggtgcggcggcgaaatattcatagcccggggagggccccgcgtccc

SEQ ID NO: 1903 - DNA, 225 bp, Unknown
  Encodes 16S rRNA from Prevotella
agagtttgatcatggctcagattgaacgctggcggcaggcttaacacatgcaagtcgaggggcagcatgggaggtggcaacaccacccgatggcgaccggcgcactggtgagtaacacgtatgcaacctgccccctacagggggataatccagagaaatttggtctaataccccgtagtcagcgagagggcatcctcttgctgggagagctccggcggtagggga

SEQ ID NO: 1904 - DNA, 225 bp, Unknown
  Encodes 16S rRNA from Saccharofermentans
agagtttgatcctggctcagaacgaacgctggcggcgcgtcttaagcatgcaagtcgagcgggaataagggagcttgcttccttatgagagcggcggactggtgaggtaacggcccaccaaacctacgatcggtagccgaactgagaggttgatcggccacattgggactgagacacggcccagactcctacgggaggcagcagtggggaatattgggcaatggg

SEQ ID NO: 1905 - DNA, 225 bp, Unknown
  Encodes 16S rRNA from unknown taxa
agagtttgatcctggctcaggacgaacgctggcggtgtgcctcatacatgcaagtcgaacgagaagctgacttcggttagtggaaagtggcggacgggtgagtacaacataggaaatctgccccaaagcgggggacaacagagggaaacttctgctaataccccatacgagcttagttgaaatactaatcttgaaagatttatcactttgggatgagcctgtgcc

SEQ ID NO: 1906 - DNA, 225 bp, Unknown
  Encodes 16S rRNA from Proteiniphilum
agagtttgatcatggctcaggatgaacgctagcgacaggcttaacacatgcaagtcgaggggcagcatgggcgtggcaacacgcctgatggcgaccggcgcactggtgagtaacacgtatgcgacctgcctccttcagggggataacccagagaaatttggcctaataccccatagtccgcgcggctgcatggccgtgcggggaaagcctcggcggaaggagatg

SEQ ID NO: 1907 - DNA, 225 bp, Unknown
  Encodes 16S rRNA from Schwartzia
agagtttgatcctggctcaggacgaacgctggcggcgtgcttaacacatgcaagtcgaacgaggcgatttgaaagcttgcttttgatgagcctagtggcaaacgggtgagtaacgcgtaggcaacctgccctcaggatggggacaacggcccgaaaggaccgctaataccgaatgacgtatcgggaccgcatgatcctgataccaaaggcggagcaatccgtcac

SEQ ID NO: 1908 - DNA, 225 bp, Unknown
  Encodes 16S rRNA from Anaerorhabdus
agagtttgatcatggctcaggatgaacgctggcggcgtgcttaatacatgcaagtcgaacgaacaaaatcagaaagcttgctttttgatctagttagtggcgaacgggtgagtaatacgtaggcaacctacctcaaagagggggatagcagttggaaacgactattaataccgcataggtaatgaaggggcatccctacattattaaaggtgcgtttgcaccgct

SEQ ID NO: 1909 - DNA, 225 bp, Unknown
  Encodes 16S rRNA from Robinsoniella
agagtttgatcctggctcaggatgaacgctggcggcgtgcctaacacatgcaagtcgagcgatgaataaaccgacaaggtttcggccaaggaagtttattcagagcggcggatgggtgaggaacgcgtggggaacctgcctttcaccgggggataccagctggaaacggctgttaataccgcatatgctcacagtgccgcatggcacagggaggaaaactccggg

SEQ ID NO: 1910 - DNA, 225 bp, Unknown
  Encodes 16S rRNA from Clostridium IV
agagtttgatcatggctcaggacgaacgctggcggcgtgcctaacacatgcaagtcgaacggagtgttgcgctgaaattgagattagcttgctaaaggatatttcttgtaacacttagtggcggacgggtgagtaacgcgtgagtaacctgccttacagagggggacaacagttggaaacgactgctaataccgcataaagttttttgtaggcatctataagaaa

SEQ ID NO: 1911 - DNA, 225 bp, Unknown
  Encodes 16S rRNA from Erysipelotrichaceae incertae sedis
agagtttgatcatggctcaggatgaacgctggcggcatgcctaagacatgcaagtcgaacgaagtgtcccgttgaagtttggagtgcttgcacaaaaaatggatacggattcgcacttagtggcagacgggtgagtaacacgtgggtaatctacctcggagactgggataactattagaaatgatagctaataccggataattcgtaatcggataactgattatg

SEQ ID NO: 1912 - DNA, 225 bp, Unknown
  Encodes 16S rRNA from Flavobacterium
agagtttgatcatggctcaggatgaacgctagcggcaggcttaacacatgcaagtcgaggggcagcggggcgtagcaatacgccgccggcgaccggcgcacgggtgcgtaacgcgtatgcaacccacccgcaacaggggtataacggagtgaaaattccactaatcccccatatggtttggggaccgcatggtttcctaacgaaagcttatttgtggttgcggac

SEQ ID NO: 1913 - DNA, 225 bp, Unknown
  Encodes 16S rRNA from Pedobacter
agagtttgatcatggctcaggatgaacgctagcggcaggcctaatacatgcaagtcgaacgggaagggtccttcggggccctgagagtggcgcacgggtgcgtaacgcgtatgcaaccaacccctttccgggggacagccggtggaaacgccgggtaataccccatgtcgacgaaggaggacatcctctttcgttgaaagacttcggtcggagagggacgggcat

SEQ ID NO: 1914 - DNA, 225 bp, Unknown
  Encodes 16S rRNA from Clostridium III
agagtttgatcatggctcaggacgaacgctggcggcgtgcctaacacatgcaagtcgaacgagaaatatgacaatgaatccttcgggatgatttggattatggacagtggcggacgggcgagtaacgcgtgagtaacctgcccataagagagggatagccgatggaaacgtcgagtaataccacatattgtagttaattcgcatggattgattatgaaagattta

SEQ ID NO: 1915 - DNA, 225 bp, Unknown
  Encodes 16S rRNA from Selenomonas
agagtttgatcatggctcaggacgaacgctggcggcgtgcttaacacatgcaagtcgaacgagacgattgaaagcttgcttttgaaagtcgagtggcaaacgggtgagtaacgcgtagacaacctgccgcaaagatggggacaacagtccgaaaggactgctaataccgaatgttgtatcgtttccgcatggagatgatattaaagatggcctctacttgtaagc

SEQ ID NO: 1916 - DNA, 225 bp, Unknown
  Encodes 16S rRNA from Rhizobium
agagtttgatcctggctcagaacgaacgctggcggcaggcttaacacatgcaagtcgagcgccccgcaaggggagcggcagacgggtgagtaacgcgtgggaatctaccgtaccctacggaataacgcatggaaacgtgtgctaataccgtatacgccctttgggggaaagatttatcggggtatgatgagcccgcgttggattagctagttggtggggtaaagg

SEQ ID NO: 1917 - DNA, 225 bp, Unknown
  Encodes 16S rRNA from Victivallis
agagtttgatcatggctcagaacgaacgctggcggcatggattaggcatgcaagtcgaacgaagcagcaatgcttagtggcggaagggtgaggaacgcgtgagtaatctgccctcaagttgggaataacaactggaaacggttgctaataccgaatgtggctgcaagaccgcatgattttgcagttaaagatttattgcttgaggatgagctcgcgtcccattag

SEQ ID NO: 1918 - DNA, 225 bp, Unknown
  Encodes 16S rRNA from Butyricimonas
agagtttgatcatggctcaggatgaacgctagcggcaggcttaacacatgcaagtcgaggggcagcgggtctagcaatagatgccggcgaccggcgaaagggtgagtaacgcgtgagcaacatacccttgacagggggataggcactggaaacggtgtgtaataccccgtaacacattccaccgcatgatgggatattgaaagattcattggtcaaggattggct

SEQ ID NO: 1919 - DNA, 225 bp, Unknown
  Encodes 16S rRNA from Parabacteroides
agagtttgatcctggctcaggatgaacgctagcgacaggcttaacacatgcaagtcgaggggcagcgggcgagtggcaacacttgctgtcggcgaccggcgcactggtgagtaacacgtatgcaacctgcccccttctgggagataacccatagaaatgtggcctaatatcccatagtcggcccagccgcatggccgggccgggaaaggcgagccggaaggggat

SEQ ID NO: 1920 - DNA, 225 bp, Unknown
  Encodes 16S rRNA from Adhaeribacter
agagtttgatcatggctcaggatgaacgctagcggcaggcctaatacatgcaagtcgaacggtaaacggtccttcgggactgtgagagtggcggacgggtgcgtaacgcgtatgcaaccaacccccgacgggcggacagccggtggaaacgccggataatacgccatggggcccagggagggcatcctttccgggccaaagcctcggcggtcggggacgggcatg

SEQ ID NO: 1921 - DNA, 225 bp, Unknown
  Encodes 16S rRNA from Eubacterium
agagtttgatcatggctcaggattaacgctggcggcgtgcctaacacatgcaagtcgagcgagaaacagtgaagagattcttcggatgaacagatctgtggacagcggcggacgggtgagtaacgcgtgggcaacctgcccctttccggaggatagccaagggaaactttgaataatactccataaagcatcattgccgcatgacagagatgccaaagatttatc

SEQ ID NO: 1922 - DNA, 225 bp, Unknown
  Encodes 16S rRNA from unknown taxa
agagtttgatcatggctcaggattaacgctggcggcgtgcctaatgcatgcaagtcgaacgtggtctcttcggagattaacgtggcggacgggtgaggaacacgtggggaacctgcccatcggtggggggtagcccgcggaaacgcggggtaattccgcatacggtctcctgggggtagctcaggagaggaaagggtcttcggactcgccgatggaggggcctgc

SEQ ID NO: 1923 - DNA, 225 bp, Unknown
  Encodes 16S rRNA from Treponema
agagtttgatcctggctcagaacgaacgctggcggcgcgttttaagcatgcaagtcgagcgggaatcgggggcaactccgaggagagcggcggacgggtgagtaacacgtggataatctatcttttagactgggatagcctggtgaaagtcaggataataccggataatacgtaatccgcacaagcggagaacgggaaaggagctaaggcttcgcttgaaggtga

SEQ ID NO: 1924 - DNA, 225 bp, Unknown
  Encodes 16S rRNA from Clostridium XlVa
agagtttgatcatggctcaggatgaacgctggcggcgtgcttaatacatgcaagtcgaacggaagatatcgggagcttgctcttgatatctttagtggcggacgggtgagtaacgcgtgggtaacctgcctcatacagggggataacagttagaaatgactgctaaaaccgcatgacatagtcaaaccgcatgatttgactatcaaatatttataggtatgagat

SEQ ID NO: 1925 - DNA, 225 bp, Unknown
  Encodes 16S rRNA from Clostridium XlVa
agagtttgatcctggctcaggacgaacgctggcggcgtgcctaacacatgcaagtcgaacgaggcgaggagtgcttgcacaccgaacctagtggcggacgggtgcgtaacgcgtgggtaacctgccctaaacagggggataacgtatagaaatgtacgctaataccgcataagctcacggaaccgcatggttttgagggaaaaggatttccggtttaggatgggc

SEQ ID NO: 1926 - DNA, 225 bp, Unknown
  Encodes 16S rRNA from Schwartzia
agagtttgatcatggctcaggacgaacgctggcggcgtgcttaacacatgcaagtcgaacggggcgatttgaaagcttgcttttgatgagcctagtggcaaacgggtgagtaacgcgtaggcaacctgccctcaggatggggacaacggcccgaaaggaccgctaataccgaatgacgtatcgggatcgcatgatactgataccaaaggcggagcaatccgtcac

SEQ ID NO: 1927 - DNA, 225 bp, Unknown
  Encodes 16S rRNA from Prevotella
agagtttgatcctggctcaggatgaacgctagctacaggcttaacacatgcaagtcgaggggcagcatgggagttgcttgcaattcccgatggcgaccggcggatgggtgagtaacgcgtatccaacctgtcccgcgcgcggggacagcccttggaaatgaggattaacccccgatacgccatggggccgcatggtcccctggtgaacctttgcgcgggttgggg

SEQ ID NO: 1928 - DNA, 225 bp, Unknown
  Encodes 16S rRNA from Selenomonas
agagtttgatcatggctcagattgaacgctggcggcgtgcttaacacatgcaagtcgaacgagacgatttagaagcttgcttttattgagtcgagtggcaaacgggtgagtaacgcgtagacaacctgccgcaaagatggggacaacagtccgaaaggactgctaataccgaatgttgtatctcctccgcatggaagagatattaaagatggcctctacttgtaa

SEQ ID NO: 1929 - DNA, 225 bp, Unknown
  Encodes 16S rRNA from Beijerinckia
agagtttgatcatggctcagaacgaacgctggcggcaggcttaacacatgcaagttgaacgggatccttaagatagcttgctatattaaggtgagagtagcgcacgggtgagtaacacgtgggaacataccttatagtgtgggataacaattggaaacgattgataataccgcataagccctgagggggaaaggaggaattcgctataagattggcccgcggaag

SEQ ID NO: 1930 - DNA, 225 bp, Unknown
  Encodes 16S rRNA from Eubacterium
agagtttgatcctggctcaggacgaacgctggcggcgtgcttaacacatgcaagtcgaacgaagcttgattgatgattacttcggtatgatttatgatatgactgagtggcggacgggtgagtaacgcgtgagtaacctgcctcttggagggggatagtgtttggaaacgaacagtaataccgcataacgtgcagagaaggcatcttttttgtaccaaagattta

SEQ ID NO: 1931 - DNA, 225 bp, Unknown
  Encodes 16S rRNA from Adhaeribacter
agagtttgatcatggctcaggatgaacgctggcggcaggcttaatacatgcaagtcgaacggtaacgaccggtagcaatactggggcgacgagtggcgcacgggtgcgtaacgcgtatgcaacctgccctcaaccgggacataacgtcgagaaattggcgctaatatcccatgtgtatgcgaggcggcatcgtcttacatataaagattcattggttgaggatgg

SEQ ID NO: 1932 - DNA, 225 bp, Unknown
  Encodes 16S rRNA from unknown taxa
agagtttgatcatggctcagaacgaacgctggtagcgtggattaggcatgcaagtcgaacgggatccgggagatagcaatatttcctggtgagagtggcggaagggcgaggaacacgtgaacaacctgtccatcaggtggggaaaaccgttggaaacgacggctaataccgaatgtggcgtcgtgacacatgtcatgaacgctaaagggggcccgcaagggctct

SEQ ID NO: 1933 - DNA, 225 bp, Unknown
  Encodes 16S rRNA from Desulfobulbus
agagtttgatcctggctcagaacgaacgctggcggcgtgcttaacacatgcaagtcgaacgcgaaagcggcttcggtcgtgagtagagtggcgcacgggtgagtaacgcgtagataacctgtcttcatatctgggataacacgccgaaaggggtactaataccggatatactcgcatttcaataggtgaggcgagaaaaggtggcctctggttcaagctactgta

SEQ ID NO: 1934 - DNA, 225 bp, Unknown
  Encodes 16S rRNA from Bacteroides
agagtttgatcctggctcaggatgaacactagctacaggcttaacacatgcaagtcgaggggcagcattaagtcagcttgctgatttagatggcgaccggcgcacgggtgagtaacgcgtatccaacctgccccctacccggggatagccttgcgaaagtaagattaatacccggtgcagttatgattccgcatgggaatataacgaaagattcatcggtggggg

SEQ ID NO: 1935 - DNA, 225 bp, Unknown; identical to SEQ ID NO: 742
  Encodes 16S rRNA from Rummeliibacillus

SEQ ID NO: 1936 - DNA, 224 bp, Unknown
  Encodes 16S rRNA from Agarivorans
agagtttgatcatggctcagattgaacgctggcggcaggcttaacacatgcaagtcattgcacaatgggggaaaccctgatgcagccatgccgcgtgtgtgaagaaggccttcgggttgtaaagcacttttgcattcgaggaagacagcgtataaataaatgcgctatttgacgttagagtgtgaataagcaccggcaaactccgtgccagcagccgcggtaat

SEQ ID NO: 1937 - DNA, 225 bp, Unknown
  Encodes 16S rRNA from Clostridium XlVa
agagtttgatcctggctcaggatgaacgctggcggcgtgcctaacacatgcaagtcgaacggagatttggcgctgacgagtgaagtagcttgctatggaacaaatcttgccaaagcttagtggcggacgggtgagtaacgcgtggacaacctggcccatacagggggacagcagctggaaacggctgataataccgcataagcgcacagtatcacatggtacagt

SEQ ID NO: 1938 - DNA, 225 bp, Unknown
  Encodes 16S rRNA from Selenomonas
agagtttgatcctggctcaggacgaacgctggcggcgtgcttaacacatgcaagtcgaacggggctattagaagcttgcttttaagagcctagtggcaaacgggtgagtaacgcgtaggcaacctgcctctaagatggggacaacagtccgaaaggactgctaataccgaatgacgtaagtatctcgcatgggaaacttaccaaagatggcctctgcttgtaagc

SEQ ID NO: 1939 - DNA, 225 bp, Unknown
  Encodes 16S rRNA from unknown taxa
agagtttgatcctggctcagaacgaacgctggtagcgtggattaggcatgcaagtcgaacgggatcaggaaggcagcaatgtcggcctgtgagagtggcggaagggcgaggaacacgtgagcaacctgtccttgaggtggggaaaactccgggaaactggagctaataccgaatgtggcgccgggagacatcttccgagcgctaaagggggccgaaaggctctcc

SEQ ID NO: 1940 - DNA, 225 bp, Unknown
  Encodes 16S rRNA from Prevotella
agagtttgatcctggctcaggatgaacgctagcggcaggcttaacacatgcaagtcgaggggcagcgggtccagcaatggatgccggcgaccggcgaaagggtgagtaacgcgtgagcaacgtgcccgtctgagggggatagtcattggaaacgatgcgtaataccccgtaacaacatttaccgcatggtgggtgtttgaaagatttattgcagacggatcggct

SEQ ID NO: 1941 - DNA, 225 bp, Unknown
  Encodes 16S rRNA from Spirochaeta
agagtttgatcctggctcagaacgaacgctggcggcgcgttttaagcatgcaagtcgagcggtaagccggagcaatccggtgtagagcggcggacgggtgagtaacacgtggataatctggcctttagttcgggatagcctggtgaaagtcaggataataccggatacgacgcttatggcacaagcgataagcgggaaaggagccaaggctttgctgaaggatga

SEQ ID NO: 1942 - DNA, 225 bp, Unknown
  Encodes 16S rRNA from Selenomonas
agagtttgatcatggctcaggacgaacgctggcggcgtgcttaacacatgcaagtcgaacggggcgattagaagcttgcttttatgagcctagtggcaaacgggtgagtaacgcgtaggcaacctgcctctaagatggggacaacagtccgaaaggactgctaataccgaatgttgtaagtaactcgcatgagagacttaccaaagatggcctctacttgtaagc

SEQ ID NO: 1943 - DNA, 225 bp, Unknown
  Encodes 16S rRNA from Spiroplasma
agagtttgatcctggctcaggatgaacgctggcggcatgcctaagacatgcaagtcgaacgaggtggcccattgaaggtggagtgcttgcacgaagctggatatggattcccacctagtggcagacgggtgagtaacacgtgggttacctacctctttgttggggataacagttggaaacgattgctaataccgaataagatactcgtattgaaaggagctttca

SEQ ID NO: 1944 - DNA, 225 bp, Unknown
  Encodes 16S rRNA from Pedobacter
agagtttgatcatggctcaggatgaacgctagcggcaggcctaatacatgcaagtcgtacgggagtcccccttcggggggatgagagtggcggacgggtgcgtaacgcgtatgcaacccacccctgtcagccggatagccttgggaaaccgggggtaacacggcatgttcccgcgtgggggcatccccatacgggcaaagcggcgacgcggacggggacgggcat

SEQ ID NO: 1945 - DNA, 225 bp, Unknown
  Encodes 16S rRNA from Clostridium XlVa
agagtttgatcctggctcaggatgaacgctggcggcgtgcttaatacatgcaagtcgaacgaagcactttccccggactttttcggaacgaagggggttgtgacttagtggcggacgggtgagtaacgcgtggataacctgccccatgcagggggacaacagctggaaacggctgctaataccgcataagcgcacagtgaggcatctcacggtgtgaaaagattt

SEQ ID NO: 1946 - DNA, 225 bp, Unknown
  Encodes 16S rRNA from unknown taxa
agagtttgatcatggctcaggacgaacgctggcggcgtgcttcatacatgcaagtcgaacgagaaattgccttcgggcaatggacagtggcggacgggtgagtaatgtgtagagaatctgccctatagtgggggatagcagttggaaacgactattaataccccatatgcgcgtagttgcgatactattcgtgaaagatttatcgctataggatgagtctgcatc

SEQ ID NO: 1947 - DNA, 225 bp, Unknown
  Encodes 16S rRNA from Lactobacillus
agagtttgatcctggctcaggacgaacgctggcggcgtgcctaatacatgcaagtcgaacgcaatcttttaacaatgagtgcttgcactcagcgttttaagtgcgagtggcgaacgggtgagtaacacgtgggcaatctgcccaaaagagggggataacacttggaaacaggtgctaataccgcataaaccaactgatcgcatgatcggttgggcaaagatggtg

SEQ ID NO: 1948 - DNA, 225 bp, Unknown
  Encodes 16S rRNA from Clostridium XlVa
agagtttgatcatggctcaggatgaacgctggcggcgtgcctaacacatgcaagtcgaacggggtacagacgctgtgcggagaagtgcttgcacggaaccaaacttgtttgtacttagtggcggacgggtgagtaacgcgtggagaacctgcctcacacagggggataacagggagaaattcctgctaataccgcataagcgcacgacatggcatcatgaagtgt

SEQ ID NO: 1949 - DNA, 225 bp, Unknown
  Encodes 16S rRNA from Prevotella
agagtttgatcatggctcaggatgaacgctggcggcgtgcctaacacatgcaagtcgaggggcagcatgtaggttgcttgcaacctatgatggcgaccggcgcacgggtgcgtaacgcgtatccaaccttccccgcagtagggtgcagcccgttgaaagacggattaatcccctatgttgtccattgacggcatccgatttggacgaaagatttcatcgctgcgg

SEQ ID NO: 1950 - DNA, 225 bp, Unknown
  Encodes 16S rRNA from Prevotella
agagtttgatcctggctcaggatgaacgctagcgacaggcttaacacatgcaagtcgaggggtaacatgaagaaagcttgctttctttgatgacgaccggcgcacgggtgagtatcgcgtatccaacctgcccataagtagggaatagccttgcgaaagtaagattaatgccctatggtttccgccaaagacatctgagatggaataaagatttatcgcttatgg

SEQ ID NO: 1951 - DNA, 154 bp, Unknown
  Encodes 16S rRNA from Marinobacter
agagtttgatcctggctcagattgaacgctggcggcaggcttaacacatgcaagtcgtacggtaacagaggaagacagcgtataaataaatgcgctatttgacgttagagtgtgaataagcaccggcaaactccgtgccagcagccgcggtaat

SEQ ID NO: 1952 - DNA, 225 bp, Unknown
  Encodes 16S rRNA from Butyricimonas
agagtttgatcctggctcaggatgaacgctagcggcaggcttaacacatgcaagtcgaggggcatcgcggagtagcaatactctggcggcgaccggcggaagggtgcgtaacgcgtgagcaacttgcccgtcactgtgggataggcactggaaacggtgtgtaataccacgtaacacagcggtccgcatggacggttgttgaaagatccgttggtgacggatagg

SEQ ID NO: 1953 - DNA, 225 bp, Unknown
  Encodes 16S rRNA from Prevotella
agagtttgatcatggctcaggatgaacgctagcggcaggcctaacacatgcaagtcgaggggcagcggggtagcaataccgccggcgaccggcgcacgggtgagtaacgcgtatgtaacctagttcacaaagagggatagccttccgaaagggagattaataccacatatgatgatagcttcgcatggagcagtcatgaaaaatttattgatgtgaaatggacat

SEQ ID NO: 1954 - DNA, 225 bp, Unknown
  Encodes 16S rRNA from Dongia
agagtttgatcctggctcagaacgaacgctggcggcacgcttaacacatgcaagtcggacgggtggaagttagtttactgatggaagctagtggcggactggtgagtataatacaggaatatgcccttaggtatgggatagctttgggaaactggaggtaataccgtatgaggtcgagagaggaaagcaggaatgcgcctgaggattagcctgtatctgattagg

SEQ ID NO: 1955 - DNA, 225 bp, Unknown
  Encodes 16S rRNA from Anaerovorax
agagtttgatcatggctcaggatgaacgctggcggcgtgcctaacacatgcaagtcgagcgggattcttacgaatggagattcgtcgaagtaagtaagatgatagcggcggacgggtgagtaacgcgtaggtaacctacccccggctgcgggatagcctagggaaacctggattaataccgcatgatgcgttgaagtcacatggctttaacgccaaagatttatc

SEQ ID NO: 1956 - DNA, 225 bp, Unknown
  Encodes 16S rRNA from Butyricimonas
agagtttgatcctggctcaggatgaacgctagcggcaggcttaacacatgcaagtcgaggggcagcgcggagtagcaatactctggcggcgaccggcggaagggtgcgtaacgcgtgagcaacttgcccgtcactgtgggataggcactggaaacggtgtgtaataccacgtaacacatttgctcgcatgggtagatgttgaaaggtttaccggtgacggatggg

SEQ ID NO: 1957 - DNA, 225 bp, Unknown
  Encodes 16S rRNA from Cryptanaerobacter
agagtttgatcatggctcaggacgaacgctggcggcatgcctaacacatgcaagtcgaacggaataagaatggctgtagcgatactttcgttcttatttagtggcgaacgggtgagtaacacgtgagcaacctgccttctacacagggataacagttggaaacgactgctaataccggataagaccacactgaggcatctcagaggggtcaaagcgcttagcggt

SEQ ID NO: 1958 - DNA, 225 bp, Unknown
  Encodes 16S rRNA from Papillibacter
agagtttgatcatggctcaggatgaacgctggcggcgtgcataacacattcaagtcgaacgaagcacagttgatgaagtcttcggatggaattggctatgacttagtggcggacgggtgagtaacgcgtgagcaaccttcctggtagtgagggataacacagggaaacttgtgctaataccgcatgacgcatagacatcgcatggtgactatgccaaagacaagt

SEQ ID NO: 1959 - DNA, 225 bp, Unknown
  Encodes 16S rRNA from Clostridium sensu stricto
agagtttgatcatggctcaggacgaacgctggcggtgtgcttaatacatgcaagtcgagcggacttgcgggggcttgctcccgcaagttagcggcggacgggtgagtaacgcgcgagcaacctgcctatatctggggaataacacagagaaatttgtgctaataccgcataagaccacagtggggcatcccacaggggtaaaagatttatcggatatagatgggc

SEQ ID NO: 1960 - DNA, 225 bp, Unknown
  Encodes 16S rRNA from Escherichia/Shigella
agagtttgatcctggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccctcgggcctcttgccatcggatgtg

SEQ ID NO: 1961 - DNA, 225 bp, Unknown
  Encodes 16S rRNA from Butyricicoccus
agagtttgatcatggctcaggataaacgctggcggcgcacataagacatgcaagtcgaacggaagccgtgcgagagacaattgaagatttatctgattgagtctcacgcacaatgactttagtggcggactggtgagtaacacgtaagcaatctgcctatcagaggggaataacagtgagaaatcattgctaataccgcatatgctcacagcatcgcatgatgca

SEQ ID NO: 1962 - DNA, 225 bp, Unknown
  Encodes 16S rRNA from Prevotella
agagtttgatcatggctcaggatgaacgctagctacaggcttaacacatgcaagtcgaggggcagcatggttgttgcttgcaacaactgatggcgaccggcgcacgggtgagtaacgcgtatccaaccttcccccaagtagggaatagcccggcgaaagtcggattaatgccctatgttttccttggatggcatctgatgaggaacaaagacttgtcgcttgggg

SEQ ID NO: 1963 - DNA, 225 bp, Unknown
  Encodes 16S rRNA from Lachnospiracea incertae sedis
agagtttgatcctggctcaggatgaacgctggcggcgtgcttaacacatgcaagtcgaacggggaaacatatttgaagatttcggttggaagatatgttttctagtggcggacgggtgagtaacgcgtaaacaatctgccttagagagggggataacagatagaaatatttgctaataccgcataagaccacagctaggcatctagcaggggtaaaaggaggaat

SEQ ID NO: 1964 - DNA, 225 bp, Unknown
  Encodes 16S rRNA from Thermotalea
agagtttgatcctggctcaggatgaacgctggcggcgtgcctaacacatgcaagtcgagcgagaagcttcggagtagattcttcggatgacacactgaagtggacagcggcggacgggtgagtaacgcgtgggcaacctgcccctttccggaggatagccaagggaaactttgaataatactccataaagcagtgacatcacatggtgatactgccaaagattta

SEQ ID NO: 1965 - DNA, 225 bp, Unknown
  Encodes 16S rRNA from Cohaesibacter
agagtttgatcatggctcagaacgaacgctggcggcaggcttaacacatgcaagtcgaacggaacataggtagcttgctatctatgtcagtggcgcacgggtgagtaacgcgtaggaacctgtcttttagcctgggatagcctctggaaacggagggtaaaaccggatgagccctgagggggaaatgagtaatcagctggaagaggggcctgcgttagattaggc

SEQ ID NO: 1966 - DNA, 225 bp, Unknown
  Encodes 16S rRNA from Clostridium XVIII
agagtttgatcatggctcaggatgaacgctggcggcgtgcctaatacatgcaagtcgaacgaggattcattgatggagcttgctccggatttgaattcgagtggcgaacgggtgagtaatacatgaataatctaccccttagtctgggataccaatctgaaaagattgctaataccggataggcaattctggggcatctcggaattattaaagatgggtttccat

SEQ ID NO: 1967 - DNA, 225 bp, Unknown
  Encodes 16S rRNA from Lachnospiracea incertae sedis
agagtttgatcctggctcaggatgaacgctggcggcgtgcttaacacatgcaagtcgaacggacttttctcgctgaaaaaggaaggtgcttgcaccggagagtttcttgagggaagttagtggcggacgggtgagtaacgcgtgggtaacctgcctatcacagggggataacagttggaaacgactgctaataccgcataagcgcacggtatcgcatgatacagt

SEQ ID NO: 1968 - DNA, 225 bp, Unknown
  Encodes 16S rRNA from Spirochaeta
agagtttgatcatggctcagaacgaacgctggcggcgcgtcttaagcatgcaagtcgggcggcaagctgccttcgggcagcctagagcggcggactggtgagtaacgcgtgggtgacgcacccccttgacggggacagcccgcagaaatgcggggtaataccggataaggtcctcggggttggagcccggggaggaaaggagctattgctccgcgaggggagcgg

SEQ ID NO: 1969 - DNA, 225 bp, Unknown
  Encodes 16S rRNA from Clostridium XlVa
agagtttgatcctggctcaggatgaacgctggcggcgtgcttaacacatgcaagtcgaacgaagcactaaggatgagaccttcgggtggaattcttagtgacttagtggcggacgggtgagtaacgcgtgggtaacctgccccatacagggggataacagttggaaacgactgctaagaccgcataacaagggagtaccgcatgacacttccttcaaagatttat

SEQ ID NO: 1970 - DNA, 225 bp, Unknown
  Encodes 16S rRNA from Hydrogenoanaerobacterium
agagtttgatcatggctcaggagaaacgctggcggcgcacataagacatgcaagtcgaacggaatttagccgaatgtttacatgaggcgaagatttagtggcggacgggtgagtaacacgtgagcaacctgcctttaggagggggataacattgagaaatcagtgctaataccgcataatgcataagcttcgcatgaagcctatgccaaaggagtaatccaccta

SEQ ID NO: 1971 - DNA, 225 bp, Unknown
  Encodes 16S rRNA from Clostridium IV
agagtttgatcctggctcaggacgaacgctggcggcgtgcctaacacatgcaagtcgaacggagatattttgaatgaagacttcggttggatttcgatttatcttagtggcggacgggtgagtaacgcgtgagtaacctgcctttttgagggggataacatcgggaaatcgatgctaataccgcataatattcaagattcgcatggattttgaatcaaaggagca

SEQ ID NO: 1972 - DNA, 225 bp, Unknown
  Encodes 16S rRNA from Papillibacter
agagtttgatcctggctcaggatgaacgctggcggcgtgcataacacattcaagtcgaacgaagcactttgacggaagtcttcggacggaagttgatttgacttagtggcggacgggtgagtaacgcgtgagcaaccttcctggtagtgagggataacacagggaaacttgtgctaataccgcatgacgcatggatatcgcatggtatatatgccaaagacttgt

SEQ ID NO: 1973 - DNA, 225 bp, Unknown
  Encodes 16S rRNA from Sporosarcina
agagtttgatcatggctcaggatgaacgctggcggcatgcctaagacatgcaagtcgtacgaagcggcccactgacttatattgatacattgagagcttgctcgatttgaggatttataatgacgtggattttccgcttagtggcaaacgggtgagtaacacgtgggttacctgcctctatgttggggataccaattggaaacgattgttaataccgaatatgat

SEQ ID NO: 1974 - DNA, 225 bp, Unknown
  Encodes 16S rRNA from Selenomonas
agagtttgatcctggctcaggacgaacgctggcggcgtgcttaacacatgcaagtcgaacgagacgattgaaagcttgcttttgaaagtcgagtggcaaacgggtgagtaacgcgtagacaacctgccgcaaagatggggacaacagtccgaaaggactgctaataccgaatgttgtcatttctcccgcatgggagactgattaaagatggcctctacttgtaag

SEQ ID NO: 1975 - DNA, 225 bp, Unknown
  Encodes 16S rRNA from Papillibacter
agagtttgatcatggctcaggataaacgctggcggcgcacataagacatgcaagtcgaacggaccaaattagtttgtttacaaattgaagaggttagtggcggactggtgagtaatatgtaagcaatctgcctgttagagtggaacaacagtgagaaatcactgctaataccgcatatgccatagatgtcacatgacaacagtgggaaaggagcaatccgctaac

SEQ ID NO: 1976 - DNA, 187 bp, Unknown
  Encodes 16S rRNA from Lachnospiracea incertae sedis
agagtttgatcatggctcaggataaacgctggcggcgtgcttaattggacaatgggggaaaccctgatccagcgacgccgcgtgaacgaagaagtatctcggtatgtaaagttctatcagcagggaagataatgacggtacctgactaagaagcaccggctaaatacgtgccagcagccgcggtaat

SEQ ID NO: 1977 - DNA, 225 bp, Unknown
  Encodes 16S rRNA from Clostridium XlVa
agagtttgatcctggctcaggatgaacgctggcggcgtgcttaacacatgcaagtcgaacgaggtatagaagagaagttttcggatggatcttttataccgagtggcggacgggtgagtaacgcgtggagaacctgccccatacagggggataccaattagaaatgattgttaataccgcataagcgcacactgaggcatctcagagtgtgaaaagctccggcgg

SEQ ID NO: 1978 - DNA, 225 bp, Unknown
  Encodes 16S rRNA from Saccharofermentans
agagtttgatcatggctcaggacgaacgctggcggcgtgcctaacacatgcaagtcgagcgaggacaacggcttcggctgttgttcgagcggcggacgggtgagtaacgcgtgaacaatctgtccctgacagggggataacacttggaaacaggtgctaataccgcataagaccacgtgaccgcatggtcgaggggtcaaaggagcaatccggtgaggggtgagt

SEQ ID NO: 1979 - DNA, 225 bp, Unknown
  Encodes 16S rRNA from Clostridium IV
agagtttgatcatggctcaggacgaacgctggcggcgtgcctaacacatgcaagtcgaacggagttaaacgctgaatggatggtagcttgctactggaaattcttgtttaacttagtggcggacgggtgagtaacgcgtgagcaacctgcctttcagagggggataacggctggaaacggtcgctaataccgcataacgtatatttaaggcatcttagatatacc

SEQ ID NO: 1980 - DNA, 225 bp, Unknown
  Encodes 16S rRNA from Lachnospiracea incertae sedis
agagtttgatcctggctcaggatgaacgctggcggcgtgcttaatacatgcaagtcgaacgaagcatgttgacggaatcccctcggggaggaagatgacatgacttagtggcggacgggtgagtaacgcgtgggcaatctgccctgtacagggggacaacagttggaaacgactgctaataccgcataagcgcacgatgaccgcatggtcaggtgtgaaaaggag

SEQ ID NO: 1981 - DNA, 225 bp, Unknown
  Encodes 16S rRNA from Clostridium IV
agagtttgatcctggctcaggagaaacgctggcggcgcacataagacatgcaagtcgaacggaacttagtcgaatgtttacatgagacaaaagtttagtggcggacgggtgagtaacacgtgagcaacctgcctttaagagggggataacattgagaaatcagtgctaataccgcataacgcatttctaccgcatgatagaaatagccaaaggagaaatccgctt

SEQ ID NO: 1982 - DNA, 225 bp, Unknown
  Encodes 16S rRNA from Lachnospiracea incertae sedis
agagtttgatcatggctcaggatgaacgctggcggcgtgcctaacacatgcaagtcgaacggggtgtcagctcttcggaacggacacttagtggcggacgggtgagtaacgcgtgggtaacctgcctcatacagggggatagcagttggaaacgactgataataccgcataagcgcacagtatcgcatggtacagtgtgaaaaactccggtggtatgagatggac

SEQ ID NO: 1983 - DNA, 225 bp, Unknown
  Encodes 16S rRNA from Desulfotomaculum
agagtttgatcatggctcaggactaacgctggcggcgtgcctaacacatgcaagtcgaacgattcattttttgtagcaatatagaagatggagagtggcgcacgggtgagtaacacatagatgatctgcctttcagactgggacaactcagggaaacttgagctaataccagataagaccccatgaagggattcacgtgatcaaagggggagcaatctcctgctg

SEQ ID NO: 1984 - DNA, 225 bp, Unknown
  Encodes 16S rRNA from Pedobacter
agagtttgatcatggctcaggatgaacgctagcggcaggcctaatacatgcaagtcgaacgggaagggtccttcggggccctgagagtggcgcacgggtgcgtaacgcgtatgcaaccaacccctttccgggggacagccggtggaaacgccgggtaataccccatgtcgatccatttgggcatccaagaggattgaaagatttcggtcggagagggacgggcat

SEQ ID NO: 1985 - DNA, 225 bp, Unknown
  Encodes 16S rRNA from Anaeroplasma
agagtttgatcatggctcaggattaacgctggcggcgtgcctaatacatgcaagtcgaatggttagcttgctaaccatggcgaacgggtgagtaacacgtaggcaacctgacgtaaagccgaggataaccattggaaacgatggataatactggataggacatttggaggcatctttggatgtttaaagatttatcactttacgaggggcctgcggcgcattagc

SEQ ID NO: 1986 - DNA, 225 bp, Unknown
  Encodes 16S rRNA from Clostridium IV
agagtttgatcctggctcaggacgaacgctggcggcgtgcttaacacatgcaagtcgaacgagaatccgtggaaagagatttcggtcaatggaagcggaggaaagtggcggacgggtgagtaacgcgtgaggaacctgccttggagagggggacaacagccggaaacggctgctaataccgcatgacgcacagaggggacatccccattgtgccaaagatttatc

SEQ ID NO: 1987 - DNA, 225 bp, Unknown
  Encodes 16S rRNA from Treponema
agagtttgatcatggctcagaacgaacgctggcggcgcgtcttaagcatgcaagtcgggcgggattcatgtgcttgcacatgatgagagcggcggactggcgaggagcgcgtgggtgacgcacccctcggacggggacagccggcagaaatgccgggtgataccggatgaggtcccccttgtcggaggagggggaggaaaggggcttcggccccgccgggggagc

SEQ ID NO: 1988 - DNA, 225 bp, Unknown
  Encodes 16S rRNA from Mogibacterium
agagtttgatcctggctcaggatgaacgctggcggcgtgcctaatacatgcaagtcgagcgagatactttcaaatgagacttcggtggattttggaggttgaaagcggcggacgggtgagtaacgcgtaggcaacctgccctttgcacagggatagccattggaaacgatgattaatacctgataacgcgggagcgatgcatatcgcttccgtcaaagattcatc

SEQ ID NO: 1989 - DNA, 225 bp, Unknown
  ITS sequence of Candida pararugos
tcctccgcttattgatatgcttaagttcagcgggtgatcttacttgatatgaggtcaaaatttgataattttccacagcttgtgtctaacaactgtgtataatctttttcagtccatatagtgaaccattacccactaatatatatgtggagaaaaaatgacgctcacacaagtatacctccaaagaggtgcaatgtgcgttcaaaaactcaatgattcacgtct

SEQ ID NO: 1990 - DNA, 225 bp, Unknown
  ITS sequence of Dipodascaceae s
tcctccgcttattgatatgcttaagttcagcgggtaatcctacttgatctgaggttgaatagtgttgtttttcaaacgaatttgattcgaaattttagaagagcaaagcaattccaagagagaaacaacgctcaaacaagtatactttgggggataccccaaagtgcaatgtgcgttcaaaaactgatgattcacttctgcaattcacaagaaatatcgcgtttc

SEQ ID NO: 1991 - DNA, 225 bp, Unknown
  ITS sequence of Orpinomyces sp AF CTS CHO
tcctccgcttattgatatgcttaagttcagcgggtactcttatctgatttgagatcaagttatttttaaattaaattttccttttaaattaagcaacaattaatattttaatttttaccctttaaaactgaaaagtttattcctttttacgggaaaattttatccaattttattagataaaaaccaaaaaaaattggcttttaaaaatcaatttaaagtgaaaca

SEQ ID NO: 1992 - DNA, 225 bp, Unknown
  ITS sequence of Candida catenulat
tcctccgcttattgatatgcttaagttcagcgggtagtcttacgtgtgtgagggaaaaagtatggttgtgagtaaactgtaatactacaccaatcactttttggaggaacagctgacgccgtatgtccattacctgcgagggagataaccgctcacacacgcatgcccgcgggaatacccacgggcgcaatgtgcgttcaaagattcgatgattcacaaaatctg

SEQ ID NO: 1993 - DNA, 225 bp, Unknown
  ITS sequence of Aspergillus cibariu
tcctccgcttattgatatgcttaagttcagcgggtatccctacctgatccgaggtcaacctggttaaaaagattggttgcgaggctagctgccagctggacctacgggagcgggtgacaaagccccatacgctcgaggaccagacatggtgccgccactgccttttgggcccgtccccgttgccagggacggaagcccaacacacaagccgtgcttgagggcagc

SEQ ID NO: 1994 - DNA, 225 bp, Unknown
  ITS sequence of Candida etchellsi
tcctccgcttattgatatgcttaagttcggcgggtaatcttgcttgattgggggccataaaaaatattactgcacagagttattaacgtgtgctgttccatttctttgactccaataaggagcaacacctcgtaatccacaagaagtagattagagagaaagttcggcgctccaacaagcatgctactaggagatcctagaagcgcaatgtgcgttcaaagattc

SEQ ID NO: 1995 - DNA, 225 bp, Unknown
  ITS sequence of Anaeromyces sp K
tcctccgcttattgatatgcttaagttcagcgggtactcttatctgatttgagatcaagttgttttaaaaaatttcctttttgttttgaatatgaaaaggtatttttaaaattgtctaggttattccttggaaaaggaaaattttatccaattttaaaaattgaaattttcaaatccaatttaaaaattcaatttaaagtgaaacaacttgtatcgttgtaaaac

SEQ ID NO: 1996 - DNA, 225 bp, Unknown
  ITS sequence of Cladosporium sp 4 MU 201
tcctccgcttattgatatgcttaagttcagcgggtatccctacctgatccgaggtcaaccttagaaatggggttgttttacggcgtagcctcccgaacaccctttagcgaatagtttccacaacgcttaggggacagaagacccagccggtcgatttgaggcacgcggcggaccgcgttgcccaataccaagcgaggcttgagtggtgaaatgacgctcgaacag

SEQ ID NO: 1997 - DNA, 225 bp, Unknown
  ITS sequence of Wallemia seb
tcctccgcttattgatatgcttaagttcagcgggtaatcccatctgatttgaggtcgatttgatcaggttgtttgccaaaaattggcagttagaagcaatcactacaaattactaaggcgagattactctctgactggtgatggatgtaatccattataacacacagtattaacccattcataaggtcatcactaatcattttaaagggagtcattatacatgac

SEQ ID NO: 1998 - DNA, 225 bp, Unknown
  ITS sequence of Orpinomyces sp AF CTS CHO
tcctccgcttattgatatgcttaagttcagcgggtactcttatctgatttgagatcaagttatttgaaataaatttccttttgctattgaatttttaatttcagattaaaaaattgtcaagtttattccttttttacgggaaaattttatccaattttttaaaaattgaaaataaaaaaacaattttaaaattcaatttaaagtgaaacaacttgtatcgttgta

SEQ ID NO: 1999 - DNA, 225 bp, Unknown
  ITS sequence of Orpinomyces sp AF CTS CHO
tcctccgcttattgatatgcttaagttcagcgggtactcttatctgatttgagatcaagttatttaaaataaatttccttttcttgaaaaatttattttcgctttttaaaactgtcaaggttattcctttttacgggaaaattttatccaattttaaaaaattgaaaataaaattttacaatttaaaaattcaatttaaagtgaaacaacttgtatcgttgtaaa

SEQ ID NO: 2000 - DNA, 225 bp, Unknown
  ITS sequence of Kodamaea ohmer
tcctccgcttattgatatgcttaagttcagcgggtagtcctacttgatttgaggaaaaaaaatgagtgtactgacggtaccgttttgtagagtactgtcgtcattattttcgtgcaaacacaatacaatccgtgaggattagggaagtattcgctcaaacaagcataccattgggaatacccaatggtgcaatgtgcgttcaaagattcgatgattccgagagct

SEQ ID NO: 2001 - DNA, 225 bp, Unknown
  ITS sequence of Pichia burtoni
tcctccgcttattgatatgcttaagttcagcgggtagtcctacctgatttgaggaaaatgtgtttttagtgtggttgtcactactaaattagaaaataacaacacaagaaaaatacttttcgaatggactgactaagagctcgtgccattcaacgccaacccgcgggggttgagggagaaatgacgctcaaacaggcataccttgtggaataccacaaggtgcaa

SEQ ID NO: 2002 - DNA, 225 bp, Unknown
  ITS sequence of Pachyphloeus carneu
tcctccgcttattgatatgcttaagttaagggagtcctcttacaagtttcaagtctttcttaaaatacagtttataatattttccttttataatttaaaaatgttactttttaatttattaaagtacttatattactttctgttttttggattttacttttgtaaaatctttctttttattttatattattttttaagggacgttgaaacttatatacatcgatc

SEQ ID NO: 2003 - DNA, 225 bp, Unknown
  ITS sequence of Anaeromyces sp FFEX
tcctccgcttattgatatgcttaagttcagcgggtactcttatctgatttgagatcaagttatttgaaataaatttccttttgctattggattttattctctttcaaaaaattgtcaaggttattccttttttacgggaaaattttatccaattttttaaaaattgaaaataaaaaacaattttaaaattcaatttaaagtgaaacaacttgtatcgttgtaaaa

SEQ ID NO: 2004 - DNA, 225 bp, Unknown
  ITS sequence of Trichosporon asteroide
tcctccgcttattgatatgcttaagttcagcgggtagtcctacctgatttcaggccagagtcaaagtaattgtccttgcggacgattagaagcacgcttcaacacaatggacccagtgaaacttattacaccagacattaatgtcaaacttgctaactcttttaaggcgagcgatcagagatcgcagacgcccaaatccaatccattaggaaaccctagtggttg

SEQ ID NO: 2005 - DNA, 225 bp, Unknown
  ITS sequence of Rhizophydium sp MP 00
tcctccgcttattgatatgcttaagttaagagagtcatcttaaaaatttcaaatctttttttaacttttgaatttacttttgattttactcttaataaattcttttttataatcaattgttttaattgatttattataatttattttattttaaaaagaggatattgaaacttttatatttaattaaagctaattaaatactttcatgcattcaaatatttactt

SEQ ID NO: 2006 - DNA, 225 bp, Unknown
  ITS sequence of Vrystaatia aloeicol
tcctccgcttattgatatgcttaagttaagagagtcatcttgaaaatttcaaatcttttttaaatcgtttgaccttttcattttttacgtgattagatcaattcttattcaattaatcaattgctttaattgatttattaaatatgttattttaaaattgggatgttgaaactttcatatttaattgaagttcaattaaatactttcatgcattcaaatatttac

SEQ ID NO: 2007 - DNA, 225 bp, Unknown
  ITS sequence of Rhizophydium sp MP 00
tcctccgcttattgatatgcttaagttaagagagtcatcttaaaaatttcaaatctttttttaacttttgaatttacttttttgattttactcttaaaaaataaattcttttattttataatcaattgttttaattgatttattataatttattttattttaaaaagaggatattgaaacttttatatttaattaaagctaattaaatactttcatgcattcaaa

SEQ ID NO: 2008 - DNA, 225 bp, Unknown
  ITS sequence of Ascomycota s
tcctccgcttattgatatgcttaagttcagcgggtatccctacctgatccgaggtcaacctggaaaaaatggttggaaaacgtcggcaggcgccggccaatcctacagagcatgtgacaaagccccatacgctcgaggatcggacgcggtgccgccgctgcctttcgggcccgtccccccggagagggggacggcgacccaacacacaagccgggcttgagggca

SEQ ID NO: 2009 - DNA, 225 bp, Unknown
  ITS sequence of Wallemia seb
tcctccgcttattgatatgcttaagttcagcgggtaatcccatctgatttgaggtcgatttgatcagtttgtttgccaatggcagttagaagcaatcactacaaattactaaggcgagattactctctgactggtgatggatgtaatccattataacacacagtattaacccattcataaggtcatcactaattattttaaagggagtcattgtttatatgacaa

SEQ ID NO: 2010 - DNA, 225 bp, Unknown
  ITS sequence of Vrystaatia aloeicol
tcctccgcttattgatatgctcctctaccttgacatccgctaccttgataattttgctgttgttgtcttcttctatcttcttcttgtctacgtctatcttcttctcttctacgtctatcttcttcttctcttcttcgtctttcatcctcttgtcttcttctatcttgttcttgtctacgtctatcttcttcttgatgtcttctatcttcttctcggtgtcttcta

SEQ ID NO: 2011 - DNA, 225 bp, Unknown
  ITS sequence of Trichoderma virid
tcctccgcttattgatatgcttaaattcagcgggttcaacttattggaatcagagtaaatcgaggctgtcgttgatcttaattaggttccacgaaccgcttgcaccacaagattatcttgagcacttcatttattgtgtaattacatctactgaaatcaataacacgctcattgaggtgttttacatgtgttcagatgtgttcaaatgtcaatctaatgattgac

SEQ ID NO: 2012 - DNA, 225 bp, Unknown
  ITS sequence of Anaeromyces sp FFEX
tcctccgcttattgatatgcttaagttcagcgggtactcttatctgatttgagatcaagttatttaaataaatttccttttaataattggaattttttaatttcaattaatttaaaattgtcaaggttattcctttttacgggaaaattttatccaattttaaaaattgaattaaaaaaatacaatttaaaaattcaatttaaagtgaaacaacttgtatcgttg

SEQ ID NO: 2013 - DNA, 225 bp, Unknown
  ITS sequence of Anaeromyces sp FFEX
tcctccgcttattgatatgcttaagttcagcgggtactcttatctgatttgagatcaagttatttttaaataaatttccttttgctattgaattcttaatttcagcttaaaaaattgtcaaggttattcctttttacaggaaaattttatccaattttttaaaaattgaaaataaaaaaacaattttaaaattcaatttaaagtgaaacaacttgtatcgttgta

SEQ ID NO: 2014 - DNA, 225 bp, Unknown
  ITS sequence of Vrystaatia aloeicol
tcctccgcttattgatatgctcatgatattcctctttggaaatgctgccgttgcatggagcgtaacataagtcaatctggctgttcaagcatggaccatccattcttttgcaggttcttattctaaacaattgctttaggaacttaacggtttggcgaacagcagtaacatctgtaaaaggaccatagtatgaaccttttttgcctatatcccttgttacgactt

SEQ ID NO: 2015 - DNA, 225 bp, Unknown
  ITS sequence of Orpinomyces sp AF CTS CHO
tcctccgcttattgatatgcttaagttaagagagtcatcttaaaaatttcaaatcaaatttaaatatattaagttaatttttaaaaaatgttattttaaaattaactcgtttattatttaattaattgttttaattaattaattatatattttatttaatttttaaattgatgttgaaatttttatatttaattcaagatgaattaaatactttcatgcattcaa

SEQ ID NO: 2016 - DNA, 225 bp, Unknown
  ITS sequence of Candida glabrat
tcctccgcttattgatatgcttaagttcggcgggtaatcttatctggcttgatgttttatatattgttgatattgaaaatatgtttttctttaatatcaaaatcgttaaaacccacaagtgtatttgatgggtcaagcaacaaacaatcaaacagatataaagccgagtctcctttggctttgcaaaatgcgttcaaagattcgatgattcacagaataatgcac

SEQ ID NO: 2017 - DNA, 225 bp, Unknown
  ITS sequence of Neocallimastix s
tcctccgcttattgatatgcttaagttcagcgggtactcttatctgatttgagatcaagttatttaaataaatttccttttaaaatcgttcccaaccgacgatttcaattaaaatccatttaaagtgaaacaacttgtttatcgttgtaaaacactcataaccataaaatcaaatgattttatgagaatattttactgatactcaaacagacatacttttttagt

SEQ ID NO: 2018 - DNA, 225 bp, Unknown
  ITS sequence of Anaeromyces sp SSD BRL
tcctccgcttattgatatgcttaagttcagcgggtactcttatctgatttgagatcaagttgtttaaaaaatttcctttttgttttgaataagaaaactatttttaaaattgtctaggttattccttggaaaaggaaaattttatccaattttaaaaattgaaattttcaaatccaatttaaaaattcaatttaaagtgaaacaacttgtatcgttgtaaaacac

SEQ ID NO: 2019 - DNA, 225 bp, Unknown
  ITS sequence of Trichoderma virid
tcctccgcttattgatatgcaattttcaaggttcaacccgttcagcttcgctgaccggggcaagaatctcgatacttcgtatcttcgattcttgaaggtttccatcctgaccggtttcccagtctctttgaaaacccaacagtataacatctgagaggctgtcttgtgacaacccgcaagaattcaaactctgtttggattcttgcttcgaagctctgcttcgaa

SEQ ID NO: 2020 - DNA, 225 bp, Unknown
  ITS sequence of Candida glabrat
tcctccgcttattgatatgcttaagttcagcgggtagtcttacgggggggagaaacaaagtagtcgagaacgtgttttctgactgttgattctaaggcccggaggagaaaatgtatgctccaccccgcatgcgccggagcgcgccatgtgcgttcaaagattaatgattcacgtttgcagatcatgatacgtatcgcaatttgctgcgttcttcatcggtacgag

SEQ ID NO: 2021 - DNA, 225 bp, Unknown
  ITS sequence of Candida glabrat
tcctccgcttattgatatgcttaagttcagcgggtactcccatctgatttgagataagtttatagataggccagcgtaattatgtaattcacagtcccacttggattcaaacccactaaataaaaagataggtcaagttgtgttatgctcaaacagatgtacgacaaacgtcgtgcaagatgcgttcaaagattcgatgattcacagaataatgcaattcacatt

SEQ ID NO: 2022 - DNA, 225 bp, Unknown
  ITS sequence of Anaeromyces mucronatu
tcctccgcttattgatatgcttaagttcagcgggtactcttatctgatttgagatcaagttgtttaaaaaatttcctttttgttttgaataagaaaactatttttaaaattgtctaggttattccttgcttaaaggaaaattttatccaattttaaaaattgaaattttcaaatccaattaaaaattcaatttaaagtgaaacaacttgtatcgttgtaaaacac

SEQ ID NO: 2023 - DNA, 225 bp, Unknown
  ITS sequence of Phyllosticta capitalensi
tcctccgcttattgatatgccccttaccgcttcagctgctttaagctcccttaaaacaaactcaagcttttttatgtcaagaaaggccctttcgttacttccctgcgccgaacagaaggggcaatgccccgggcaatacattgtcgggcagattgaaagctgaagctttaaaggtcttttcttttccctgttcggagcaccgtttacggagcagtgataattctt

SEQ ID NO: 2024 - DNA, 225 bp, Unknown
  ITS sequence of Schizangiella serpenti
tcctccgcttattgatattcatatatcctatttgatgagatcaaagaacttaataattacttattttttctttctgtgatcttcttaatattattttattaaaaaataatacccaaatacattatctagttttcaaagaactatttctgagagaacaatctctcaaaactaagcaaaacgttatagctagatcttcttttctacaaatatactccatagaaagga

SEQ ID NO: 2025 - DNA, 225 bp, Unknown
  ITS sequence of Pleosporaceae s
tcctccgcttattgatatgcttaagttcagcgggtatccctacctgatccgaggtcaaaagttgaaaaaaggctttgtggatgctgaccttggctggaagagagcgcgacttgtgctgcgctccgaaaccagtaggccggctgccaattactttaaggcgagtctccagcgaactggagacaagacgcccaacaccaagcaaagcttgagggtacaaatgacgct

SEQ ID NO: 2026 - DNA, 225 bp, Unknown
  ITS sequence of Alternaria sp 3 MU 201
tcctccgcttattgatatgcttaagttcagcgggtatccctacctgatccgaggtcaaaagttgaaaaaaaggcttaatggatgctagacctttgctgatagagagtgcgacttgtgctgcgctccgaaaccagtaggccggctgccaattactttaaggcgagtctccagcaaagctagagacaagacgcccaacaccaagcaaagcttgagggtacaaatgac

SEQ ID NO: 2027 - DNA, 225 bp, Unknown
  ITS sequence of Penicillium brevicompactu
tcctccgcttattgatatgcttaagttcagcgggtatccctacctgatccgaggtcaacctggaaaaaagtttggttgatcggcaggcgccggccagtcctacaaagcgggtgacaaagccccatacgcttgaggaccggacgcggtgccgccgctgcctttcgggcccgtcccccggaaggaggacggagcccaacacacaagccgtgcttgagggcagcaatg

SEQ ID NO: 2028 - DNA, 225 bp, Unknown
  ITS sequence of Cryptococcus terrestri
tcctccgcttattgatatgcttaagttcagcgggtagccctacctgatttcaggtcaaagtcaaaagtgcgcgatggcaggttctgagcagtcatcaccacaaggagagacgaaacttattacgtctaacactgatgtgggatgttccactaagtcatttgaggcgagccatcactggcagacgcccaagtccaagtctaacatgttcagaaaacatattagatt

SEQ ID NO: 2029 - DNA, 225 bp, Unknown
  ITS sequence of Rhizophydium sp MP 00
tcctccgcttattgatatgcttaagttaagagagtcatcttaaaaatttcaaatcaaaataacatttttattgaatttttttatttattaaattcaattttaaatttttttcaattaattattttaattaatttattataatttgtgttatttttttttttaattgatgttgaaatttttatatttaattcaagttgaattaaatactttcatgcattcaaatat

SEQ ID NO: 2030 - DNA, 225 bp, Unknown
  ITS sequence of Monascus purpureu
tcctccgcttattgatatgcttaagttcagcgggtatccctacctgatccgaggtcaacctaaggaaaaaaaggttggagagggcaaaggccccggcccgacctactgagcgggtgacaaagccccatacgctcgaggaccggacgcggcgccgccactgcctttcgggcccgtcccccttgcccggaggcgcaggggacggcggcccaacacacaagccgcgct

SEQ ID NO: 2031 - DNA, 225 bp, Unknown
  ITS sequence of Saccharomycetales s
tcctccgcttattgatatgcttaagttcagcgggtattcctacctgatttgaggtcgagcttatgtattaagttcggcggccaagcgtcctactcatagttcgcttcgcccgcaacgtttcttttcagagcggccccaatgccagggcccccccatttctgctcgcaagcaagaaggaaacgacgctcaaacaggcatgccctccggaataccagagggcgcaat

SEQ ID NO: 2032 - DNA, 225 bp, Unknown
  ITS sequence of Cyllamyces aberensi
tcctccgcttattgatatgcttacgttcagcgggtactcttatctgatttgagatcaagttaatttttacttttttttcctttgtaagtacttttaaaaaatcaaactaattcattcttaaaattgtttaggttattccttttttacgggaaaattttatccaattttaaaaaaaatcagtttttaaatgattttttacaagacaaagaatttaaagtgaaacaa

SEQ ID NO: 2033 - DNA, 225 bp, Unknown
  ITS sequence of Microascaceae s
tcctccgcttattgatatgcttaagttcagcgggtaaccctacctgatccgaggtcaaaccatcaggagttgaggttcgacggctggccttcgccgggacccgatgcgaggtgagctaacttactacgcagggggcgccgcggcgggaccgccacttcatttcagggcctgcgggcaacggtggcccgcagcgccccaacaccgggcggcggcgcggcccacggt

SEQ ID NO: 2034 - DNA, 198 bp, Unknown
  ITS sequence of Orpinomyces sp AF CTS CHO
tcctccgcttattgatatgcttaagttcagcgggtactcttatctgatttgagatcaagttatttataaataaatttcctttaactgtacggtatggaaactattaaaatttctaaaaaactgaaatagctttattccttgttacgacttttacttcccctccgcttattgatatgccttgttacgacttttacttcc

SEQ ID NO: 2035 - DNA, 225 bp, Unknown
  ITS sequence of Trichoderma virid
tcctccgcttattgatatgcttaagttcagcaggtactcccatccgattcgatatgaaatatatttttcgatagagtcataaattcataagactcaatccttcctcatttcagatcaacattacatgagtgatcaaagtttggtcatactcgatcggatgtggaaagcttgcgctccccagcgtgtgcgttcaaaaattggatgattcacagtgtaattgtcatt

SEQ ID NO: 2036 - DNA, 225 bp, Unknown
  ITS sequence of Orpinomyces sp AF CTS CHO
tcctccgcttattgatatgcttaagttaagagagtcatcttaaaaatttcaaatcaaatttaaatatattaagttaatttttaaaaatgttattttaaaattaactcgtttatttatttaattaattgttttaattaattaattatatttattttttttatttttaaattgatgttgaaatttttatatttaattcaagatgaattaaatactttcatgcattca

SEQ ID NO: 2037 - DNA, 225 bp, Unknown
  ITS sequence of Rhizophydium sp MP 00
tcctccgcttattgatatgcttaagttaagagagtcatcttaaaaatttcaaatcaaaaattaaatatttatttgttttaaattaattttttaaataatttaaacaaattcatttatttcaattaattatattaattaatttattataattttatttttaattttttaattgatgttgaaatttttatatttaattctagtagaattaaatactttcatgcattc

SEQ ID NO: 2038 - DNA, 225 bp, Unknown
  ITS sequence of Piromyces sp I GRL 1
tcctccgcttattgatatgcttaagttcagcgggtactcttatctgatttgagatcaagttatttagttaaattttccttttaatgaaaaaatctaatcaaaaaattaaaattgtttaggttattccttttttacgggaaaattttatccaattttattttaaaattagaaaaattcaaattttaaaaaaaatttaaagtgaaacaacttgtatagttgtaaaac

SEQ ID NO: 2039 - DNA, 225 bp, Unknown
  ITS sequence of Paracoccidioides brasiliensi
tcctccgcttattgatatgcttaagttcagcgggtatccctacctgatccgaggtcgatttctagaatatgttaatattcaagtaaaaaaatcagaccggcgacggccgggccgcgtgagcgtactatgttgaaaaaaccccatatgctcgggcaccggagtcgcgacgccgccaatgcatttcaggcaaatccctacatatcaggatgagcccaacacacaagc

SEQ ID NO: 2040 - DNA, 225 bp, Unknown
  ITS sequence of Millerozyma farinos
tcctccgcttattgatatgcttaagttcagcgggtattcctacctgatttgaggtcaaactttgtagattgttgtaaggccgagcctcttttacacagatactaccgctaactgtttcaacgagttggttagacctaatacattgaagagtcaaacggcatttatctactgtaaatactcatgccaatccatttcaagcaaatagatactgaatatctatatcgc

SEQ ID NO: 2041 - DNA, 225 bp, Unknown
  ITS sequence of Trichoderma virid
tcctccgcttattgatatgcttaaattcagctggttcaaattattggaatcagagtaaatcgagactgtcgttgatcttaattagattccacgaaccgcttgcaccacaagactatcttgagtacttcatttcatgtgtaattaagactactgaaatcaataacacgctcattgaggtgttttacatgtgttcagagataaaagttcgaaagatcatagttcgct

SEQ ID NO: 2042 - DNA, 225 bp, Unknown
  ITS sequence of Debaryomyces prosopidi
tcctccgcttattgatatgcttaagttcagcgggtagtcctacctgatttgaggtcaaacttgtttgttatattgtaaggccgagcctagaataccgagaaatatacctttaaactattcaacgagttggataaacctaatacattgaaagtcatatagcactatccagtaccactcatgccaatacatttcaagcaaacgcctagttcgactaagagtatcact

SEQ ID NO: 2043 - DNA, 225 bp, Unknown
  ITS sequence of Vrystaatia aloeicol
tcctcgcttattgatatgcttaagttaagagagtcatcttgaaaatttcaaatcttttttaaattcttttgaccttttcagtttttacgtgattagatcaattcttattcaattaatcaattgctttaattgatttattaaatatgttattttaaaattgtgatgttgaaactttcatatttaattgaagttcaattaaatactttcatgcattcaaatatttac

SEQ ID NO: 2044 - DNA, 225 bp, Unknown
  ITS sequence of Cryptococcus albidu
tcctccgcttattgatatgcttaagttcagcgggtagtcctacctgatttgaggccagatgtcaagagtattaatccgaagatcaatggattagaaagcggtctttagtcctgcaacgcggccatccgaagatgtccttagcgaaatacttattacgccaagtcaaaccatgtcgcgagacagatccagctattacttttaagacgagccgacttatcatcggca

SEQ ID NO: 2045 - DNA, 225 bp, Unknown
  Encodes 16S rRNA from Succinivibrio
agagtttgatcatggctcagattgaacgctggcggcaggcctaatacatgcaagtcgaacggtaacagtagaaaagcttgcttttctagctgacgagtggcggacgggtgagtaacatttgggaaactacctgatagagggggacaacagttggaaacgactgctaataccgcataaagcctgagggtgaaagcagcaatgcgctatcagatgtgcccaaacggg

SEQ ID NO: 2046 - DNA, 225 bp, Unknown
  Encodes 16S rRNA from Prevotella
agagtttgatcatggctcaggatgaacgctagctacaggcttaacacatgcaagtcgaggggcagcatgaagtttgcttgcaaactttgatggcgaccggcgcacgggtgagtaacgcgtatccaaccttccctatactagaggatagcccggcgaaagtcggattaatactctatgttcttcgtagaagacatctgaaatgaagcaaaggtttaccggtatagg

SEQ ID NO: 2047 - DNA, 225 bp, Unknown
  Encodes 16S rRNA from Prevotella
agagtttgatcatggctcaggatgaacgctagctacaggcttaacacatgcaagtcgaggggcagcatgatcgaagcttgctttgattgatggcgaccggcgcacgggtgagtaacgcgtatccaaccttccctatagtagagaatagcccggcgaaagtcggattaatgctctatgttgtatttagaagacatctgaagaataccaaaggtttaccgctatagg

SEQ ID NO: 2048 - DNA, 225 bp, Unknown
  Encodes 16S rRNA from Prevotella
agagtttgatcctggctcaggatgaacgctagctacaggcttaacacatgcaagtcgaggggtaacgatattgaaagcttgctttcgataggcgacgaccggcgcacgggtgagtaacgcgtatccaacctgcccataactaagggataatccgtagaaatgcggtctaataccttatgtgttccgacgaggacatctgaattggaataaagatttatcggttat

SEQ ID NO: 2049 - DNA, 225 bp, Unknown
  Encodes 16S rRNA from Ruminobacter
agagtttgatcatggctcagattgaacgctggcggcaggcttaatacatgcaagtcgaacggtaacatgagaaagcttgctttcttgatgacgagtggcggacgggtgagtaatgcctgggaagctgcctgaatgagggggacaacacctggaaacgggtgctaataccgcgtataccctgagggggaaagaccggatacggtcacattcagatgcgcccaggtg

SEQ ID NO: 2050 - DNA, 225 bp, Unknown
  Encodes 16S rRNA from Syntrophococcus
agagtttgatcctggctcaggatgaacgctggcggcgtgcttaacacatgcaagtcgagcgaagcacagaaacggatttcttcggattgaaggttctgtgactgagcggcggacgggtgagtaacgcgtggggaacctgccctgtaccgggggataacagacagaaatgtctgctaataccgcataagcgcacgagaaggcatcttcttgtgtgaaaaactccgg

SEQ ID NO: 2051 - DNA, 225 bp, Unknown
  Encodes 16S rRNA from Succinivibrio
agagtttgatcatggctcagattgaacgctggcggcaggcctaatacatgcaagtcgaacggtaacataagaaagcttgctttcttgatgacgagtggcggacgggtgagtaatatttgggaagctacctgatagagggggacaacagttggaaacgactgctaataccgcatacagcctgagggtgaaagcagcaatgcgctatcagatgcgcccaaacgggat

SEQ ID NO: 2052 - DNA, 225 bp, Unknown
  Encodes 16S rRNA from Pseudobutyrivibrio
agagtttgatcatggctcaggatgaacgctggcggcgtgcttaacacatgcaagtcgaacgaagcaattttctacgatcccttcggggtgacggattattgactgagtggcggacgggtgagtaacgcgtgggtaacctaccttgtacagggggacaacagttggaaacgactgctaataccgcataagcgcacagcatcgcatgatgcagtgtgaaaagttttt

SEQ ID NO: 2053 - DNA, 225 bp, Unknown
  Encodes 16S rRNA from Prevotella
agagtttgatcatggctcaggatgaacgctagctacaggcttaacacatgcaagtcgaggggcagcataacgaaagcttgcttttgttgatggcgaccggcgcacgggtgagtaacgcgtatccaaccttccccatagtagagaatagcccggcgaaagtcggattaatgctctatgttgtatcatgaggacatctgaataataccaaaggttcaccgctatggg

SEQ ID NO: 2054 - DNA, 225 bp, Unknown
  Encodes 16S rRNA from Prevotella
agagtttgatcatggctcaggatgaacgctagctacaggcttaacacatgcaagtcgaggggcagcatgatcgaagcttgctttgattgatggcgaccggcgcacgggtgagtaacgcgtatccaaccttccctatagtagagaatagcccggtgaaaatcggattaatgctctatgttattcaatgcggacatctaagttgaatcaaaggtttaccgctatagg

SEQ ID NO: 2055 - DNA, 225 bp, Unknown
  Encodes 16S rRNA from Prevotella
agagtttgatcatggctcaggatgaacgctagctacaggcttaacacatgcaagtcgaggggtaacgacagcgaaagcttgcttttgctgggcgacgaccggcgcacgggtgagtaacgcgtatccaacctgcccataactaagggataatccgtagaaatgcggtctaataccttatgtgttccgacgaagacatctgaattggaataaagatttatcggttat

SEQ ID NO: 2056 - DNA, 225 bp, Unknown
  Encodes 16S rRNA from Prevotella
agagtttgatcatggctcaggatgaacgctagctacaggcttaacacatgcaagtcgaggggaaacgatattgaaagcttgctttctttaggcgtcgaccggcgaatgggtgagtaacgcgtatccaacctgcccctgagtaagggatagcccatcgaaagatggattaataccttatggtttcctttgaaggcatcagattaggaataaagatttatcgctgag

SEQ ID NO: 2057 - DNA, 225 bp, Unknown
  Encodes 16S rRNA from Lachnospiracea_incertae_sedis
agagtttgatcatggctcaggatgaacgctggcggcgtgcttaacacatgcaagtcgaacgaagtcttctagacagattccttcgggatgacgactagatgtacttagtggcggacgggtgagtaacgcgtgggtaacctgcctcatacagggggataacagttggaaacagctgctaataccccataagcgcacaatgtcgcatgacaaagtgtgaaaaactcc

SEQ ID NO: 2058 - DNA, 225 bp, Unknown
  Encodes 16S rRNA from Syntrophococcus
agagtttgatcatggctcaggatgaacgctggcggcgtgcttaacacatgcaagtcgagcgaagcacttgaatggatttcttcggattgaagttcttgtgacttagcggcggacgggtgagtaacgcgtgggaaacctgcctcatatcgggggataacagttggaaacgactgctaataccgcataagcgcacagtaccgcatggtacggtgtgaaaaactccgg

SEQ ID NO: 2059 - DNA, 225 bp, Unknown
  Encodes 16S rRNA from Ruminobacter
agagtttgatcatggctcagattgaacgctggcggcaggcttaatacatgcaagtcgaacggtaacagcaggaagcttgcttcctggctgacgagtggcggacgggtgagtaatacctggggagctgcctgaatgagggggacaacacctggaaacgggtgctaataccgcgtaagccctgagggggaaaggctgggcaaccagtcgcattcagatgcgcccagg

SEQ ID NO: 2060 - DNA, 225 bp, Unknown
  Encodes 16S rRNA from Butyrivibrio
agagtttgatcatggctcaggatgaacgctggcggcgtgcctaacacatgcaagtcgaacggagaatttacgctgatgaagcttcggcagattcttgtaaattcttagtggcggacgggtgagtaacgcgtgggcaacctgcctcatactgggggataacagctggaaacgactgttaataccgcataagcgcacggtatcgcatgatacagtgtgaaaaactcc

SEQ ID NO: 2061 - DNA, 225 bp, Unknown
  Encodes 16S rRNA from Clostridium_XlVa
agagtttgatcatggctcaggatgaacgctggcggcgtgcttaacacatgcaagtcgaacgaagcatttacttacgatctcttcggagtgacgagtttatgactgagtggcggacgggtgagtaacgcgtgggtaacctgccttgtacagggggataacagttagaaatgactgctaataccgcataagcgcacagtattgcatgatacagtgtgaaaaactccg

SEQ ID NO: 2062 - DNA, 225 bp, Unknown
  Encodes 16S rRNA from Prevotella
agagtttgatcctggctcaggatgaacgctagctacaggcttaacacatgcaagtcgaggggcagcataatcgaagcttgctttgattgatggcgaccggcgcacgggtgagtaacgcgtatccaaccttccccttagtagggcatagcccggcgaaagtcggattaataccctatgttatccgtcgaggacatctgaaatggattaaagatttatcgctaaggg

SEQ ID NO: 2063 - DNA, 225 bp, Unknown
  Encodes 16S rRNA from Prevotella
agagtttgatcatggctcaggatgaacgctagctacaggcttaacacatgcaagtcgaggggaaacgatattggaagcttgcttccgataggcgtcgaccggcgcacgggtgagtaacgcgtatccaacctgcccatcacttgggaataaccttgcgaaagtaagactaatgcccaatgacatttatagaaggcatctgaaatgaattaaagatttatcggtgat

SEQ ID NO: 2064 - DNA, 225 bp, Unknown
  Encodes 16S rRNA from Lachnospiracea_incertae_sedis
agagtttgatcatggctcaggatgaacgctggcggcgtgcttaacacatgcaagtcgaacggagtacttctcccgagactgaggaagcttgcttctgaagaatcatttgaagtacttagtggcggacgggtgagtaacgcgtgggtaacctgcctcacacagggggataacagttggaaacgactgttaataccgcataagcgcacagtatcgcatgatacagtg

SEQ ID NO: 2065 - DNA, 225 bp, Unknown
  Encodes 16S rRNA from Roseburia
agagtttgatcatggctcaggatgaacgctggcggcgtgcttaacacatgcaagtcgaacggacttatattgaaagtttcggccggatatataagttagtggcggacgggtgagtaacgcgtgggtaacctgccttacaccgggggataacagttggaaacgactgctaataccgcataagcccacagtaccgcatggtacagggggaaaagttgaggcgatgta

SEQ ID NO: 2066 - DNA, 225 bp, Unknown
  Encodes 16S rRNA from Lachnospiracea_incertae_sedis
agagtttgatcatggctcaggatgaacgctggcggcgtgcttaacacatgcaagtcgaacgaagcaacttatcacgattccttcgggatgacgatttgttgactgagtggcggacgggtgagtaacgcgtgggtaacctgccttatacagggggatagcagctggaaacggctgataataccgcataagcgcacagcatcgcatgatgcagtgtgaaaaactccg

SEQ ID NO: 2067 - DNA, 225 bp, Unknown
  Encodes 16S rRNA from Butyrivibrio
agagtttgatcctggctcaggatgaacgctggcggcgtgcctaacacatgcaagtcgaacggagtttaacgctgatgaagcttcggcagattcttgttaaacttagtggcggacgggtgagtaacgcgtgggtaacctgcctcatacagggggatagcagttggaaacgactgataacaccgcataagcgcacggtatcgcatgatacagtgtgaaaatatttat

SEQ ID NO: 2068 - DNA, 225 bp, Unknown
  Encodes 16S rRNA from Pseudobutyrivibrio
agagtttgatcatggctcaggatgaacgctggcggcgtgcttaacacatgcaagtcgaacgaagcagtttattacgatcccttcggggtgacgatttactgactgagtggcggacgggtgagtaacgcgtgggtaacctgccttgtacagggggacaacagttggaaacgactgctaataccgcataagcgcacagcttcgcatgaagcagtgtgaaaagtattt

SEQ ID NO: 2069 - DNA, 225 bp, Unknown
  Encodes 16S rRNA from Turicibacter
agagtttgatcatggctcaggatgaacgctggcggcgtgcctaatacatgcaagtcgaacgaggtgtagcaatacaccgagtggcgaacgggtgagtaacacgtaggtaacctgcccctaagtctgggatacccaggggaaaccttggctaataccggatagcggcggaggggacatcccttccgcacgaaagtcgcgtttgcgacgctttcggatggacctgcg

SEQ ID NO: 2070 - DNA, 225 bp, Unknown
  Encodes 16S rRNA from Lachnospiracea_incertae_sedis
agagtttgatcctggctcaggatgaacgctggcggcgtgcttaacacatgcaagtcgaacggagatttaccacctgcttgcaggaggtaaatcttagtggcggacgggtgagtaacgcgtgggtaacctgcctcacacagggggataacagttggaaacgactgttaataccgcataagcgcacggtatcgcatgatacagtgtgaaaaactccggtggtgtgag

SEQ ID NO: 2071 - DNA, 225 bp, Unknown
  Encodes 16S rRNA from Pseudobutyrivibrio
agagtttgatcctggctcaggatgaacgctggcggcgtgcttaacacatgcaagtcgaacgaagcaatttcttacgatcccttcggggtgacgagttattgactgagtggcggacgggtgagtaacgcgtgggtaacctaccttgtacagggggacaacagttggaaacgactgctaataccgcataagcgcacggtgttgcatgacacagtgtgaaaagttttt

SEQ ID NO: 2072 - DNA, 225 bp, Unknown
  Encodes 16S rRNA from Anaerolinea
agagtttgatcatggctcaggatgaacgctggcggcgtgcctaatacatgcaagtcggacggcagtagcaatactgtagtggcgaacgggtgagtaacacgttggtgacctgccccaaagatgggaatatcacctggaaacgggtggcaaaaccgaataagctcgtgtgagttagagaagcatgagtaaaagagcgatctactttgggaggggcctgcggcccat

SEQ ID NO: 2073 - DNA, 225 bp, Unknown
  Encodes 16S rRNA from Roseburia
agagtttgatcctggctcaggatgaacgctggcggcgtgcttaacacatgcaagtcgaacgaagcactttacttgatctcttcggagtgattgttctgtgactgagtggcggacgggtgagtaacgcgtgggtaacctgccttgtacaggggggataacagttggaaacgactgctaataccgcataagcgcacaggaccgcatggtccggtgtgaaaaactccg

SEQ ID NO: 2074 - DNA, 225 bp, Unknown
  Encodes 16S rRNA from Propionibacterium
agagtttgatcatggctcaggacgaacgctggcggcgtgcttaacacatgcaagtcgaacggaaaggccctgcttttgtggggtgctcgagtggcgaacgggtgagtaacacgtgagtaacctgcccttgactttgggataacttcaggaaactggggctaataccggataggagctcctgctgcatggtgggggttggaaagtttcggcggttggggatggact

SEQ ID NO: 2075 - DNA, 225 bp, Unknown
  Encodes 16S rRNA from Clostridium_XIVa
agagtttgatcatggctcaggatgaacgctggcggcgtgcttaacacatgcaagtcgaacgagccttgtcggacggatcccttcggggtgaagaccggcgctggcgagtggcggacgggtgagtaacgcgtggggaacctgcctcattccgggggataccagtcggaaacggctgttaataccgcataagcgcacggtgtggcatcacacagtgtgaaaaactcc

SEQ ID NO: 2076 - DNA, 225 bp, Unknown
  Encodes 16S rRNA from Olsenella
agagtttgatcatggctcaggatgaacgctggcggcgcgcctaacacatgcaagtcgaacggttaaagcacctccgggtgtgcataaagtggcgaacggctgagtaacacgtgggcaacctgcccctcgcaccgggacagcctcgggaaaccgtggataataccggatactccggcacccccgcatgggggagccgggaaagcccagacggcgagggatgggccc

SEQ ID NO: 2077 - DNA, 225 bp, Unknown
  Encodes 16S rRNA from Streptococcus
agagtttgatcctggctcaggacgaacgctggcggcgtgcctaatacatgcaagtggaacgcagtagtgatcaccggagcttgctccaccgattagtactgagtcgcgaacgggtgagtaacgcgtaggtaacctgccttgaagagggggataactattggaaacgatagctaataccgcataaaatagcgagttgcatgactggctattgaaaggtgcaatcgc

SEQ ID NO: 2078 - DNA, 225 bp, Unknown
  Encodes 16S rRNA from Clostridium_XlVa
agagtttgatcatggctcaggatgaacgctggcggcgtgcctaacacatgcaagtcgaacggagattagacgctgacgagacttcggtcaaatcttgtttaatcttagtggcggacgggtgagtaacgcgtgggcaacctgcctcatactgggggatagcagttggaaacgactgataataccgcataagcgcacgagatcgcatgatctagtgtgaaaaactcc

SEQ ID NO: 2079 - DNA, 225 bp, Unknown
  Encodes 16S rRNA from Clostridium_XlVa
agagtttgatcatggctcaggatgaacgctggcggcgtgcctaacacatgcaagtcgaacggagatttaacgctgatgaagcttcggcagaatcttgttaaatcttagtggcggacgggtgagtaacgcgtgggcaacctgcctcatactgggggatagcagttggaaacgactgataataccgcataagcgcacggagtcgcatgactctgtgtgaaaaactcc

SEQ ID NO: 2080 - DNA, 225 bp, Unknown
  Encodes 16S rRNA from Roseburia
agagtttgatcctggctcaggatgaacgctggcggcgtgcttaacacatgcaagtcgaacgggaattactttttagcttgctaagttgtaattctagtggcggacgggtgagtaacgcgtgggtaacctgccttataccgggggacaacagttggaaacgactgctaataccgcataagcgcacagtctcgcatgagacggtgtgaaaaactccggtggtataag

SEQ ID NO: 2081 - DNA, 225 bp, Unknown
  Encodes 16S rRNA from Clostridium_IV
agagtttgatcatggctcaggacgaacgctggcggcgtgcctaacacatgcaagtcgaacggagatatgtcgaatgaagatttcggttggaatttgatatatcttagtggcggacgggtgagtaacgcgtgagtaacctgccgatgagagtggaataacgttctgaaaagaacgctaataccgcataacgtatcgaagccgcatgacattgataccaaagatttt

SEQ ID NO: 2082 - DNA, 225 bp, Unknown
  Encodes 16S rRNA from Clostridium_XICa
agagtttgatcctggctcaggatgaacgctggcggcgtgcctaacacatgcaagtcgagcggagagccgtaacggaagccttcgggtggaagatacggttacttagcggcggacgggtgagtaacgcgtggataacctggctcatacagggggataacagagagaaatttctgctaataccgcataagcgcacgtaaccgcatggttatgtgtgaaaagccgaga

SEQ ID NO: 2083 - DNA, 225 bp, Unknown
  Encodes 16S rRNA from Lachnospiracea_incertae_sedis
agagtttgatcatggctcaggataaacgctggcggcgtgcttaacacatgcaagtcgaacggagtattccttcggaagatcgaagagcttgctcggagagattctttggaatacttagtggcggacgggtgagtaacgcgtgggtaacctgcctcacacagggggataacagttggaaacgactgttaataccgcataagcgcacagtaccgcatggtacagtgt

SEQ ID NO: 2084 - DNA, 225 bp, Unknown
  Encodes 16S rRNA from Erysipelotrichaceae_incertae_sedis
agagtttgatcctggctcaggatgaacgctggcggcatgcctaatacatgcaagtcgaacggagaaggaaggtgcttgcatcttccggatcagtggcgaacgggtgagtaacacgtaggtaacctgcccatgtacccgggacaacggttggaaacgactgctaaaaccggataggcatatggaaggcatcttcgatatgttaaaggggccacggccctggacatg

SEQ ID NO: 2085 - DNA, 225 bp, Unknown
  Encodes 16S rRNA from Solobacterium
agagtttgatcctggctcaggataaacgctggcggcgtgcctaatacatgcaagtcgatcgctggaattcaagcttgcttgaatgaaggagaggcgaacgggtgagtaatacataagcaacctgcccacgaagactgggataatctctggaaacggggactaataccggataggtaacgaaggcgcatgcctctgttattaaagatgagaagcactggtggatgg

SEQ ID NO: 2086 - DNA, 225 bp, Unknown
  Encodes 16S rRNA from Lachnospiracea_incertae_sedis
agagtttgatcatggctcaggatgaacgctggcggcgtgcttaacacatgcaagtcgaacggagtatctctcccgagaccaaagaagcttgcttctgaggaatcaattgagatacttagtggcggacgggtgagtaacgcgtgggtaacctgcctcacacagggggataacagttggaaacgactgttaataccgcataagcgcacagtaccgcatggtacagtg

SEQ ID NO: 2087 - DNA, 225 bp, Unknown
  Encodes 16S rRNA from Clostridium_XlVa
agagtttgatcctggctcaggatgaacgctggcggcgtgcctaacacatgcaagtcgaacggagatataacgctgcagagacttcggtcaaagcttgttgtatcttagtggcggacgggtgagtaacgcgtgggcaacctgcctcatactgggggataacagttggaaacggctgttaataccgcataagcgcacagagtcgcatgactcagtgtgaaaaactcc

SEQ ID NO: 2088 - DNA, 225 bp, Unknown
  Encodes 16S rRNA from Ralstonia
agagtttgatcatggctcagattgaacgctggcggcatgccttacacatgcaagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcgg

SEQ ID NO: 2089 - DNA, 225 bp, Unknown
  Encodes 16S rRNA from Clostridium_XlVa
agagtttgatcctggctcaggatgaacgctggcggcgtgcctaacacatgcaagtcgaacggaagcttaacgctgacgagacttcggtcaaatcttgttaagctttagtggcggacgggtgagtaacgcgtgggcaacctgcctcatactgggggataacagttggaaacgactgttaataccgcataagcgcacagagtcgcatgactcagtgtgaaaaactcc

SEQ ID NO: 2090 - DNA, 225 bp, Unknown
  Encodes 16S rRNA from Eubacterium
agagtttgatcatggctcaggatgaacgctggcggcgtgcctaacacatgcaagtcgagcgggaagctcacaaatgattcttcggatgaatgcgtgagtgaacagcggcggacgggtgagtaacgcgtgggcaacctgccccttactgaaggatagccgagggaaacttcgagtaatacttcataatgcatttttttcacatggagggaatgccaaagatttatc

SEQ ID NO: 2091 - DNA, 225 bp, Unknown
  Encodes 16S rRNA from Lachnobacterium
agagtttgatcatggctcaggatgaacgctggcggcgtgcttaacacatgcaagtcgaacgaagcacctctaatcgaagattgagaaagcttgcttttgattgattcaccttgaggtgactgagtggcggacgggtgagtaacgcgtgggtaacctaccctatacagggggataacagttggaaacgactgctaataccgcataagcgcacaggaccgcatggtc

SEQ ID NO: 2092 - DNA, 225 bp, Unknown
  Encodes 16S rRNA from Acholeplasma
agagtttgatcatggctcaggataaacgctggcggcatgcctaatacatgcaagtcgaacggagttaccttcgggtaacttagtggcgaacgggtgagtaacacgtaggtaatccatcccaaggacgaggatagcttctggaaacggaaggtaaaactggatagttaattaaagggcatcctttagttattaaaagagcaatctaccctgggaagagcctgcggc

SEQ ID NO: 2093 - DNA, 225 bp, Unknown
  Encodes 16S rRNA from Selenomonas
agagtttgatcctggctcaggacgaacgctggcggcgtgcttaacacatgcaagtcgaacgaggtcgaatgagaagcttgctttttatgaagccgagtggcaaacgggtgagtaacgcgtagacaacctgccgtgaagatggggacaacagatcgaaaggtctgctaataccgaatgttgtagatcctccgcatgaaggattcactaaaggtgccctctgtatat

SEQ ID NO: 2094 - DNA, 225 bp, Unknown
  Encodes 16S rRNA from Prevotella
agagtttgatcatggctcaggatgaacgctagctacaggcttaacacatgcaagtcgaggggcagcataacgaaagcttgcttttgttgatggcgaccggcgcacgggtgagtaacgcgtatccaaccttccctatagtagagaatagcccggcgaaagtcggattaatgctctatgttgtatttagaagacatctgaagaataccaaaggtttaccgctatagg

SEQ ID NO: 2095 - DNA, 225 bp, Unknown
  Encodes 16S rRNA from Clostridium_XlVa
agagtttgatcatggctcaggatgaacgctggcggcgtgcctaacacatgcaagtcgaacggagatttaacgctgatgaggcttcggcggaatcttgttaaatcttagtggcggacgggtgagtaacgcgtgggcaacctgcctcatactgggggataacagttggaaacgactgttaataccgcataagcgcacagtgtcgcatgacacagtgtgaaaaactcc

SEQ ID NO: 2096 - DNA, 225 bp, Unknown
  Encodes 16S rRNA from Succinivibrio
agagtttgatcatggctcagattgaacgctggcggcaggcctaatacatgcaagtcgaacggtaacatggaagtagcaatacttttgatgacgagtggcggacgggtgagtaatatttgggaatctacctatcagagggggatagcaactggaaacggttgataagaccgcgtacgctctgaggaggaaagtaatgggatcgcaagaccattagctgatagatga

SEQ ID NO: 2097 - DNA, 225 bp, Unknown; identical to SEQ ID NO: 2059
  Encodes 16S rRNA from Ruminobacter

SEQ ID NO: 2098 - DNA, 225 bp, Unknown
  Encodes 16S rRNA from Sharpea
agagtttgatcctggctcaggatgaacgctggcggcgtgcctaatacatgcaagtcggacggagcgcttcggcgctcagtggcgaacgggtgagtagcacatgggcaacctgcccttcagagggggacaacagctggaaacggctgctaagaccgcataggcgcggacgggacatcccgtccacgttaaacgtccttacggggacggctgaaggatgggcctgtg

SEQ ID NO: 2099 - DNA, 225 bp, Unknown
  Encodes 16S rRNA from Prevotella
agagtttgatcctggctcaggatgaacgctagctacaggcttaacacatgcaagtcgaggggaaacggcattttagcttgctaagatggacgtcgaccggcgaatgggtgagtaacgcgtatccaaccttccgttaagtagggaatagccttgcgaaagtaagattaatgccctatgtggtgttttgaggacatctgaagatcaccaaaggtttaccgcttaacg

SEQ ID NO: 2100 - DNA, 225 bp, Unknown
  Encodes 16S rRNA from Prevotella
agagtttgatcatggctcaggatgaacgctagctacaggcttaacacatgcaagtcgaggggtaacgacagcgaaagcttgcttttgctggtcgacgaccggcgaatgggtgagtaacgcgtatccaacctgccgcaaagtagggcacagccttgcgaaagtaagattaatgccctatgtgctgtgatgaggacatctgaattgcagtaaaggttcaccgctttg

SEQ ID NO: 2101 - DNA, 225 bp, Unknown; identical to SEQ ID NO: 2046
  Encodes 16S rRNA from Prevotella

SEQ ID NO: 2102 - DNA, 225 bp, Unknown
  Encodes 16S rRNA from Prevotella
agagtttgatcctggctcaggatgaacgctagctacaggcttaacacatgcaagtcgaggggcagcattatcgaagcttgctttgatagatggcgaccggcgcacgggtgagtaacgcgtatccaaccttccccttagtagggcatagcccgtagaaatgcggattaataccctatgttgtattatgaggacatctgaataataccaaaggttcaccgctaaggg

SEQ ID NO: 2103 - DNA, 225 bp, Unknown
  Encodes 16S rRNA from Prevotella
agagtttgatcatggctcaggatgaacgctagctacaggcttaacacatgcaagtcgaggggcatcagatcgaaagcttgcttttgatgctggcgaccggcgcacgggtgagtaacgcgtatccaaccttccctatagtagagaatagcccggcgaaagtcggattaatgctctatgttgtatttagaagacatctgaagaataccaaaggtttaccgctatagg

SEQ ID NO: 2104 - DNA, 225 bp, Unknown
  ITS sequence of Orpinomyces
tcctccgcttattgatatgcttaagttcagcgggtactcttatctgatttgagatcaagttattttgttaaatttccttttaattaggctcaactaaagttttaccttttaaaactgaaaagttattcctttttacgggaaaattttatccaattttattagataaaaccaaaattggcttttaaaaatcaatttaaagtgaaacaacttgtttatcgttgtaaa

SEQ ID NO: 2105 - DNA, 225 bp, Unknown
  ITS sequence of Piromyces
tcctccgcttattgatatgcttaagttcagcgggtactcttatctgatttgagatcaagttatttagttaaattttccttttagtttggattttctaatcaaaaattaaaattgtttaggttattcctttttacgggaaaattttatccaattttattttaaaattagaaaaattcaaattttaaaaaaatttaaagtgaaacaacttgtatcgttgtaaaacac

SEQ ID NO: 2106 - DNA, 225 bp, Unknown
  ITS sequence of Piromyces
tcctccgcttattgatatgcttaagttcagcgggtactcttatctgatttgagatcaagttatttagttaaattttcctttataattgaaaagaattctaatcaaaaattaaaattgtttaggttattccttttttacgggaaaattttatccaattttattttaaaattagaaaaattcaaattttaaaaaaaatttaaagtgaaacaacttgtatcgttgtaa

SEQ ID NO: 2107 - DNA, 225 bp, Unknown
  ITS sequence of Piromyces
tcctcgcttattgatatgcttaagttcagcgggtactcttatctgatttgagatcaagttatttattaaattttcctttataatgaaaaattctaatcaaaaaactaaaattgtttaggttattccttttttacgggaaaattttatccaattttattttaaaattagaaaaattcaaattttaaaaaaatttaaagtgaaacaacttgtatcgttgtaaaacac

What is claimed is:

1. A method for increasing milk production or improving milk compositional characteristics in a ruminant, the method comprising:
   a) orally administering to a ruminant an effective amount of a ruminant supplement comprising:
      i. a purified microbial population that comprises a bacteria with a 16S nucleic acid sequence and/or a fungi with an ITS nucleic acid sequence, which is selected from the group consisting of: SEQ ID NOs: 1-60 and 2045-2107; and
      ii. a carrier suitable for ruminant administration,
   wherein at least one of the bacteria or fungi are capable of converting a carbon source into a volatile fatty acid selected from the group consisting of: acetate, butyrate, propionate, or combinations thereof; and
   wherein at least one of the bacteria or fungi are capable of degrading a soluble or insoluble carbon source; and
   wherein the ruminant administered the effective amount of the ruminant supplement exhibits an increase in milk production or improved milk compositional characteristics, as compared to a ruminant not administered the ruminant supplement.

2. The method according to claim 1, wherein the ruminant is a cow.

3. The method according to claim 1, wherein the ruminant supplement is formulated as an: encapsulation, tablet, capsule, pill, feed additive, food ingredient, food additive, food preparation, food supplement, consumable solution, consumable spray additive, consumable solid, consumable gel, bolus, drench, or combinations thereof.

4. The method according to claim 1, wherein the ruminant supplement is encapsulated in a polymer or carbohydrate.

5. The method according to claim 1, wherein administering comprises: feeding the ruminant supplement to a ruminant.

6. The method according to claim 1, wherein the purified microbial population is present in the ruminant supplement in an amount of at least $10^2$ cells.

7. The method according to claim 1, wherein the purified microbial population comprises a bacteria with a 16S nucleic acid sequence selected from the group consisting of: SEQ ID NOs: 1-30 and 2045-2103.

8. The method according to claim 1, wherein the purified microbial population comprises a fungi with an ITS nucleic acid sequence selected from the group consisting of: SEQ ID NOs: 31-60 and 2104-2107.

9. The method according to claim 1, wherein the purified microbial population comprises a bacteria with a 16S nucleic acid sequence and a fungi with an ITS nucleic acid sequence selected from the group consisting of: SEQ ID NOs: 1-60 and 2045-2107.

10. The method according to claim 1, wherein the purified microbial population comprises a bacteria with a 16S nucleic acid sequence of SEQ ID NO: 28.

11. The method according to claim 1, wherein the purified microbial population comprises a fungi with an ITS nucleic acid sequence of SEQ ID NO: 32.

12. The method according to claim 1, wherein the purified microbial population comprises a *Pichia* fungi as deposited at NRRL Y-67249.

13. The method according to claim 1, wherein the purified microbial population only contains organisms that are members of a group selected from:
   *Intestinimonas, Anaerolinea, Pseudobutyrivibrio, Olsenella, Eubacterium, Catenisphaera, Faecalibacterium, Solobacterium, Blautia, Ralsonia, Coprococcus, Casaltella, Anaeroplasma, Acholeplasma, Aminiphilus, Mitsuokella, Alistipes, Sharpea, Oscillibacter, Neocallimastix, Odoribacter, Pichia, Tannerella, Candida, Hydrogenoanaerobacterium, Orpinomyces, Succinivibrio, Sugiyamaella, Ruminobacter, Lachnospira, Caecomyces, Sinimarinibacterium, Tremella, Hydrogenoanaerobacterium, Turicibacter, Clostridium* XIVa, *Anaerolinea, Saccharofermentans, Butyricicoccus, Olsenella, Papillibacter, Clostridium* XIa, *Pelotomaculum, Erysipelotrichaceae incertae sedis, Lachnospiracea incertae sedis, Solobacterium, Anaeroplasma, Ralstonia, Clostridium sensu stricto, Eubacterium, Rikenella, Lachnobacterium, Tannerella, Acholeplasma, Howardella, Selenomonas, Butyricimonas, Sharpea, Succinivibrio, Ruminobacter, Candida, Syntrophococcus, Pseudobutyrivibrio, Orpinomyces, Cyllamyces, Saccharomycetales, Phyllosticta, Ascomycota,* and *Piromyces*.

14. The method according to claim 1, wherein the ruminant administered the effective amount of the ruminant supplement exhibits an increase in milk production that leads to a measured increase in milk yield.

15. The method according to claim 1, wherein the ruminant administered the effective amount of the ruminant supplement exhibits an increase in milk production and improved milk compositional characteristics that leads to a measured increase in energy-corrected milk.

16. The method according to claim 1, wherein the ruminant administered the effective amount of the ruminant supplement exhibits an improved milk compositional characteristic selected from the group consisting of: an increase in milk fat(s), an increase in milk protein(s), an increase of carbohydrates in milk, an increase of vitamins in milk, an increase of minerals in milk, or combinations thereof.

17. The method according to claim 1, wherein the ruminant administered the effective amount of the ruminant supplement exhibits at least a 1% increase in the average production of: milk fat(s), milk protein(s), energy-corrected milk, or combinations thereof.

18. The method according to claim 1, wherein the ruminant administered the effective amount of the ruminant supplement exhibits at least a 10% increase in the average production of: milk fat(s), milk protein(s), energy-corrected milk, or combinations thereof.

19. The method according to claim 1, wherein the ruminant administered the effective amount of the ruminant supplement exhibits at least a 20% increase in the average production of: milk fat(s), milk protein(s), energy-corrected milk, or combinations thereof.

20. The method according to claim 1, wherein the ruminant administered the effective amount of the ruminant supplement, further exhibits:
- at least one improved phenotypic trait, selected from the group consisting of: an improved efficiency in feed utilization, improved digestibility, an increase in polysaccharide and lignin degradation, an increase in fatty acid concentration in the rumen, pH balance in the rumen, a reduction in methane emissions, a reduction in manure production, improved dry matter intake, an improved efficiency of nitrogen utilization, or combinations thereof.

21. The method according to claim 1, wherein the ruminant administered the effective amount of the ruminant supplement, further exhibits: a shift in the microbiome of the rumen.

22. The method according to claim 1, wherein the ruminant administered the effective amount of the ruminant supplement, further exhibits: a shift in the microbiome of the rumen,
- wherein a population of microbes present in the rumen before administration of the ruminant supplement increase in abundance after administration of the ruminant supplement.

23. The method according to claim 1, wherein the ruminant administered the effective amount of the ruminant supplement, further exhibits: a shift in the microbiome of the rumen,
- wherein a population of microbes present in the rumen before administration of the ruminant supplement decrease in abundance after administration of the ruminant supplement.

24. The method according to claim 1, wherein the ruminant administered the effective amount of the ruminant supplement, further exhibits: a shift in the microbiome of the rumen,
- wherein a first population of microbes present in the rumen before administration of the ruminant supplement increase in abundance after administration of the ruminant supplement, and
- wherein a second population of microbes present in the rumen before administration of the ruminant supplement decrease in abundance after administration of the ruminant supplement.

25. The method according to claim 1, wherein the purified microbial population comprises a bacteria with a 16S nucleic acid sequence of ID NO: 28 and a fungi with an ITS nucleic acid sequence of SEQ ID NO: 32.

26. The method according to claim 1, wherein the purified microbial population comprises a *Clostridium* bacteria as deposited at NRRL B-67248.

27. The method according to claim 1, wherein the purified microbial population comprises a *Pichia* fungi as deposited at NRRL Y-67249 and a *Clostridium* bacteria as deposited at NRRL B-67248.

\* \* \* \* \*